United States Patent 11,446,398 (REGULATED BIOCIRCUIT SYSTEMS) - sequence listing, part 15

SEQ ID NO: 64307 - protein, 522 aa, Homo sapiens
  Payload ID: 12830
  Gene Symbol: PLXNA4
  Gene Name: plexin A4
  Uniprot ID: Q9HCM2
  ENSP ID: ENSP00000367800
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKSFGTGPQGGITQEWIGVEGDPPGANIASQEQMLCVYLQCSSHKAISDQRVQPLLCCFLNVPGNSS

SEQ ID NO: 64308 - protein, 492 aa, Homo sapiens
  Payload ID: 12830
  Gene Symbol: PLXNA4
  Gene Name: plexin A4
  Uniprot ID: Q9HCM2
  ENSP ID: ENSP00000392772
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKMPGTSLCPTLELQTGPRSHRATVTLELLFSSCSSN

SEQ ID NO: 64309 - protein, 2135 aa, Homo sapiens
  Payload ID: 12831
  Gene Symbol: PLXNB1
  Gene Name: plexin B1
  Uniprot ID: O43157
  ENSP ID: ENSP00000296440
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 64310 - protein, 2135 aa, Homo sapiens; identical to SEQ ID NO: 64309
  Payload ID: 12831
  Gene Symbol: PLXNB1
  Gene Name: plexin B1
  Uniprot ID: O43157
  ENSP ID: ENSP00000351338

SEQ ID NO: 64311 - protein, 729 aa, Homo sapiens
  Payload ID: 12831
  Gene Symbol: PLXNB1
  Gene Name: plexin B1
  Uniprot ID: O43157
  ENSP ID: ENSP00000395987
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSRPASTTSMTPPGSGSWKRRPWGQAPAPVWRAFRAPR

SEQ ID NO: 64312 - protein, 1952 aa, Homo sapiens
  Payload ID: 12831
  Gene Symbol: PLXNB1
  Gene Name: plexin B1
  Uniprot ID: O43157
  ENSP ID: ENSP00000414199
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 64313 - protein, 1838 aa, Homo sapiens
  Payload ID: 12832
  Gene Symbol: PLXNB2
  Gene Name: plexin B2
  Uniprot ID: O15031
  ENSP ID: ENSP00000352288
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 64314 - protein, 161 aa, Homo sapiens
  Payload ID: 12832
  Gene Symbol: PLXNB2
  Gene Name: plexin B2
  ENSP ID: ENSP00000387470
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTG

SEQ ID NO: 64315 - protein, 477 aa, Homo sapiens
  Payload ID: 12832
  Gene Symbol: PLXNB2
  Gene Name: plexin B2
  ENSP ID: ENSP00000392620
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQ

SEQ ID NO: 64316 - protein, 234 aa, Homo sapiens
  Payload ID: 12832
  Gene Symbol: PLXNB2
  Gene Name: plexin B2
  ENSP ID: ENSP00000400679
YKPFHGDIQCGGHAPGSSKSFPCGSEHLPYPLGSRDGLRGTAVLQRGGLNLTAVTVAAENNHTVAFLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTN

SEQ ID NO: 64317 - protein, 189 aa, Homo sapiens
  Payload ID: 12832
  Gene Symbol: PLXNB2
  Gene Name: plexin B2
  ENSP ID: ENSP00000406048
  MOD_RES (1)..(1): Any amino acid
XEVWGAAPVCHWPPGDTGPDASGGLLRGVPRAQPRHLLHLPRKPRTASLRAATKLCQVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLP

SEQ ID NO: 64318 - protein, 1838 aa, Homo sapiens; identical to SEQ ID NO: 64313
  Payload ID: 12832
  Gene Symbol: PLXNB2
  Gene Name: plexin B2
  Uniprot ID: O15031
  ENSP ID: ENSP00000409171

SEQ ID NO: 64319 - protein, 84 aa, Homo sapiens
  Payload ID: 12832
  Gene Symbol: PLXNB2
  Gene Name: plexin B2
  ENSP ID: ENSP00000415757
  MOD_RES (1)..(1): Any amino acid
XTDVNFQGKNLDTVKVWMSGGGGRGKPTEDVQRLLQTQGSSLHVGSDLLKFMEPVTMQESGTFAFRTPKLSHDANETLPLHLYV

SEQ ID NO: 64320 - protein, 347 aa, Homo sapiens [sequence omitted]

SEQ ID NO: 64321 - protein, 160 aa, Homo sapiens
  Payload ID: 12832
  Gene Symbol: PLXNB2
  Gene Name: plexin B2
  ENSP ID: ENSP00000482999
GPDVTAGGPVEARQHPYALQCPGWSHPHPVQGGGLPAAGGQPAGPAWGAPCPPGGGEPGVAPGAADRRGGRGQVQERQREREGADEGHHRDLPDAAALSQGHTAAVCGQLLPERAGLGTRCHLQSSTSSTSWTSRQRSTTSRMKTPSTSGRRTAYRSGSG

SEQ ID NO: 64322 - protein, 1909 aa, Homo sapiens
  Payload ID: 12833
  Gene Symbol: PLXNB3
  Gene Name: plexin B3
  Uniprot ID: Q9ULL4
  ENSP ID: ENSP00000355378
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 64323 - protein, 258 aa, Homo sapiens
  Payload ID: 12833
  Gene Symbol: PLXNB3
  Gene Name: plexin B3
  ENSP ID: ENSP00000391650
  MOD_RES (1)..(1): Any amino acid
XSLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTEWRSGLAGHLTLSDEDLTSVTQNHWKRLNTLQHYKVPDGATVGLVPQLHRGSTISQSL

SEQ ID NO: 64324 - protein, 163 aa, Homo sapiens
  Payload ID: 12833
  Gene Symbol: PLXNB3
  Gene Name: plexin B3
  ENSP ID: ENSP00000396048
  MOD_RES (1)..(1): Any amino acid
XKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGESESLGPDLGPLESRLGR

SEQ ID NO: 64325 - protein, 175 aa, Homo sapiens
  Payload ID: 12833
  Gene Symbol: PLXNB3
  Gene Name: plexin B3
  ENSP ID: ENSP00000412454
  MOD_RES (1)..(1): Any amino acid
XASQGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRVRAVPAAAAGRGLRRKGLWGKPRGLCTELWVGSGSIMGAPSPPSSCLAPPLPPEQDSPVNKLLYAREI

SEQ ID NO: 64326 - protein, 1932 aa, Homo sapiens
  Payload ID: 12833
  Gene Symbol: PLXNB3
  Gene Name: plexin B3
  Uniprot ID: Q9ULL4
  ENSP ID: ENSP00000442736
MELTPASSLTCSLLSPRLPGSFPQLRRVPPCSRPWLPKAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 64327 - protein, 1568 aa, Homo sapiens
  Payload ID: 12834
  Gene Symbol: PLXNC1
  Gene Name: plexin C1
  Uniprot ID: O60486
  ENSP ID: ENSP00000258526
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 64328 - protein, 307 aa, Homo sapiens
  Payload ID: 12834
  Gene Symbol: PLXNC1
  Gene Name: plexin C1
  ENSP ID: ENSP00000439225
MGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 64329 - protein, 615 aa, Homo sapiens
  Payload ID: 12834
  Gene Symbol: PLXNC1
  Gene Name: plexin C1
  ENSP ID: ENSP00000446720
MQHLCLLAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 64330 - protein, 416 aa, Homo sapiens
  Payload ID: 12834
  Gene Symbol: PLXNC1
  Gene Name: plexin C1
  ENSP ID: ENSP00000446781
MTAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKPSSSLLGKHPEEPSVCL

SEQ ID NO: 64331 - protein, 103 aa, Homo sapiens
  Payload ID: 12834
  Gene Symbol: PLXNC1
  Gene Name: plexin C1
  ENSP ID: ENSP00000447625
MQHLCLLAAVGVTRHKSKELSRKQSQQLELLESELRKEIRDGFAELQMDKLDVVDSFGTVPFLDYKHFALRTFFPENRDANDKNESLTALDALICNKSFLVTV

SEQ ID NO: 64332 - protein, 109 aa, Homo sapiens
  Payload ID: 12834
  Gene Symbol: PLXNC1
  Gene Name: plexin C1
  ENSP ID: ENSP00000447843
MNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENL

SEQ ID NO: 64333 - protein, 1925 aa, Homo sapiens
  Payload ID: 12835
  Gene Symbol: PLXND1
  Gene Name: plexin D1
  Uniprot ID: Q9Y4D7
  ENSP ID: ENSP00000317128
MAPRAAGGAPLSARAAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLSEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 64334 - protein, 112 aa, Homo sapiens
  Payload ID: 12835
  Gene Symbol: PLXND1
  Gene Name: plexin D1
  ENSP ID: ENSP00000423832
  MOD_RES (1)..(1): Any amino acid
XRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPTT

SEQ ID NO: 64335 - protein, 55 aa, Homo sapiens
  Payload ID: 12835
  Gene Symbol: PLXND1
  Gene Name: plexin D1
  ENSP ID: ENSP00000426162
MTPLSEQEMNAHLAEESRKYQNEFNTNVAMAEIYKYAKRYRPQLLYIKKRIMHQL

SEQ ID NO: 64336 - protein, 169 aa, Homo sapiens
  Payload ID: 12835
  Gene Symbol: PLXND1
  Gene Name: plexin D1
  ENSP ID: ENSP00000426241
LQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYP

SEQ ID NO: 64337 - protein, 380 aa, Homo sapiens
  Payload ID: 12835
  Gene Symbol: PLXND1
  Gene Name: plexin D1
  ENSP ID: ENSP00000426540
  MOD_RES (1)..(1): Any amino acid
XEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLSEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNRWRPSSPVLGEHPEEPPVCL

SEQ ID NO: 64338 - protein, 231 aa, Homo sapiens
  Payload ID: 12835
  Gene Symbol: PLXND1
  Gene Name: plexin D1
  ENSP ID: ENSP00000427696
  MOD_RES (1)..(1): Any amino acid
XSLHPGSLLKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQ

SEQ ID NO: 64339 - protein, 500 aa, Homo sapiens
  Payload ID: 12836
  Gene Symbol: PLXDC1
  Gene Name: plexin domain containing 1
  Uniprot ID: Q8IUK5
  ENSP ID: ENSP00000323927
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 64340 - protein, 222 aa, Homo sapiens
  Payload ID: 12836
  Gene Symbol: PLXDC1
  Gene Name: plexin domain containing 1
  ENSP ID: ENSP00000393227
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSA

SEQ ID NO: 64341 - protein, 460 aa, Homo sapiens
  Payload ID: 12836
  Gene Symbol: PLXDC1
  Gene Name: plexin domain containing 1
  ENSP ID: ENSP00000409687
MALSVRTLPLRGFLVPRPQPTRSQDAPSPRLPLSSAPAPCRHKNEEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 64342 - protein, 124 aa, Homo sapiens
  Payload ID: 12836
  Gene Symbol: PLXDC1
  Gene Name: plexin domain containing 1
  ENSP ID: ENSP00000416819
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDN

SEQ ID NO: 64343 - protein, 337 aa, Homo sapiens
  Payload ID: 12836
  Gene Symbol: PLXDC1
  Gene Name: plexin domain containing 1
  Uniprot ID: Q8IUK5
  ENSP ID: ENSP00000462089
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQSRDEVSPC

SEQ ID NO: 64344 - protein, 99 aa, Homo sapiens
  Payload ID: 12836
  Gene Symbol: PLXDC1
  Gene Name: plexin domain containing 1
  ENSP ID: ENSP00000462241
MDTLPDNRTRVVVWEGTGSTGSAWELVGNVECRSPQTCRIRIRFPGGQPQLLCVPSLWPQRAPQPGTVGRCGRGQPEPSEDPHNTLQHPPAGFESGLVL

SEQ ID NO: 64345 - protein, 98 aa, Homo sapiens
  Payload ID: 12836
  Gene Symbol: PLXDC1
  Gene Name: plexin domain containing 1
  ENSP ID: ENSP00000464029
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTA

SEQ ID NO: 64346 - protein, 182 aa, Homo sapiens
  Payload ID: 12836
  Gene Symbol: PLXDC1
  Gene Name: plexin domain containing 1
  ENSP ID: ENSP00000464353
QGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRSLNNQDENTCSSGFDRYRQEWMDYGCAQEAEGRMCEDFQDEDHDSASPDTSFSPYDGDLTTT

SEQ ID NO: 64347 - protein, 480 aa, Homo sapiens
  Payload ID: 12837
  Gene Symbol: PLXDC2
  Gene Name: plexin domain containing 2
  Uniprot ID: Q6UX71
  ENSP ID: ENSP00000366450
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIERVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 64348 - protein, 529 aa, Homo sapiens
  Payload ID: 12837
  Gene Symbol: PLXDC2
  Gene Name: plexin domain containing 2
  Uniprot ID: Q6UX71
  ENSP ID: ENSP00000366460
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 64349 - protein, 175 aa, Homo sapiens
  Payload ID: 12838
  Gene Symbol: PMF1-BGLAP
  Gene Name: PMF1-BGLAP readthrough
  ENSP ID: ENSP00000324909
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWCEAQRCRVQQRCSLCVQAGGQRGSEETQALPVSMAGSPSPLPGSPGAQEGGV

SEQ ID NO: 64350 - protein, 220 aa, Homo sapiens
  Payload ID: 12838
  Gene Symbol: PMF1-BGLAP
  Gene Name: PMF1-BGLAP readthrough
  ENSP ID: ENSP00000357259
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRCEAQRCRVQQRCSLCVQAGGQRGSEETQALPVSMAGSPSPLPGSPGAQEGGV

SEQ ID NO: 64351 - protein, 142 aa, Homo sapiens
  Payload ID: 12838
  Gene Symbol: PMF1-BGLAP
  Gene Name: PMF1-BGLAP readthrough
  ENSP ID: ENSP00000458021
MAEASSANLGSGCEEKRHEGSSSESVPPGTTISRVKLLDTMVDTFLQKLVAAGRRPSGIPEKDLHSVMAPYFLQQRDTLRRHVQKQEAENQQLADAVLAGRRQVEELQLQVQAQQQAWQVRSPAVQSPAKVQPLCPSRRAAR

SEQ ID NO: 64352 - protein, 211 aa, Homo sapiens
  Payload ID: 12838
  Gene Symbol: PMF1-BGLAP
  Gene Name: PMF1-BGLAP readthrough
  ENSP ID: ENSP00000475561
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQVRSPAVQSPAKVQPLCPSRRAAR

SEQ ID NO: 64353 - protein, 670 aa, Homo sapiens
  Payload ID: 12839
  Gene Symbol: PRAM1
  Gene Name: PML-RARA regulated adaptor molecule 1
  Uniprot ID: Q96QH2
  ENSP ID: ENSP00000408342
MAHHLPAAMESHQDFRSIKAKFQASQPEPSDLPKKPPKPEFGKLKKFSQPELSEHPKKAPLPEFGAVSLKPPPPEVTDLPKKPPPPEVTDLPKKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRSPQPELSTFPKKPAQPEFNVYPKKPPQPQVGGLPKKSVPQPEFSEAAQTPLWKPQSSEPKRDSSAFPKKASQPPLSDFPKKPPQPELGDLTRTSSEPEVSVLPKRPRPAEFKALSKKPPQPELGGLPRTSSEPEFNSLPRKLLQPERRGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPQVPDEIYELYDDVEPRDDSSPSPKGRDEAPSVQQAARRPPQDPALRKEKDPQPQQLPPMDPKLLKQLRKAEKAEREFRKKFKFEGEIVVHTKMMIDPNAKTRRGGGKHLGIRRGEILEVIEFTSNEEMLCRDPKGKYGYVPRTALLPLETEVYDDVDFCDPLENQPLPLGR

SEQ ID NO: 64354 - protein, 180 aa, Homo sapiens
  Payload ID: 12839
  Gene Symbol: PRAM1
  Gene Name: PML-RARA regulated adaptor molecule 1
  ENSP ID: ENSP00000471634
MAHHLPAAMESHQDFRSIKAKFQASQPEPSDLPKKPPKPEFGKLKKFSQPELSEHPKKAPLPEFGAVSLKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRS

SEQ ID NO: 64355 - protein, 108 aa, Homo sapiens
  Payload ID: 12840
  Gene Symbol: PMS1
  Gene Name: PMS1 homolog 1, mismatch repair system component
  ENSP ID: ENSP00000343888
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVQL

SEQ ID NO: 64356 - protein, 165 aa, Homo sapiens
  Payload ID: 12840
  Gene Symbol: PMS1
  Gene Name: PMS1 homolog 1, mismatch repair system component
  ENSP ID: ENSP00000363959
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGSHSVTQAGLQWHHLGSLQPLPPRLK

SEQ ID NO: 64357 - protein, 181 aa, Homo sapiens
  Payload ID: 12840
  Gene Symbol: PMS1
  Gene Name: PMS1 homolog 1, mismatch repair system component
  ENSP ID: ENSP00000386623
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGKKVALYTNILYLFCLNCWFKKKKLLGEYKYIALGLVLIKAS

SEQ ID NO: 64358 - protein, 893 aa, Homo sapiens
  Payload ID: 12840
  Gene Symbol: PMS1
  Gene Name: PMS1 homolog 1, mismatch repair system component
  Uniprot ID: P54277
  ENSP ID: ENSP00000387125
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 64359 - protein, 555 aa, Homo sapiens
  Payload ID: 12840
  Gene Symbol: PMS1
  Gene Name: PMS1 homolog 1, mismatch repair system component
  Uniprot ID: P54277
  ENSP ID: ENSP00000387169
MSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLNLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 64360 - protein, 711 aa, Homo sapiens
  Payload ID: 12840
  Gene Symbol: PMS1
  Gene Name: PMS1 homolog 1, mismatch repair system component
  ENSP ID: ENSP00000389938
MKQLPAATVRLLSSSQIITSVVSVVKELIENSLDAGATSVDVKLVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPL

SEQ ID NO: 64361 - protein, 73 aa, Homo sapiens
  Payload ID: 12840
  Gene Symbol: PMS1
  Gene Name: PMS1 homolog 1, mismatch repair system component
  ENSP ID: ENSP00000391136
MKQLPAATVRLLSSSQIITSVVSVVKELIENSLDAGATSVDVKLENYGFDKIEVRDNGEGIKAVDAPVMAMKY

SEQ ID NO: 64362 - protein, 266 aa, Homo sapiens
  Payload ID: 12840
  Gene Symbol: PMS1
  Gene Name: PMS1 homolog 1, mismatch repair system component
  ENSP ID: ENSP00000396232
MILNSLRYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLE

SEQ ID NO: 64363 - protein, 756 aa, Homo sapiens
  Payload ID: 12840
  Gene Symbol: PMS1
  Gene Name: PMS1 homolog 1, mismatch repair system component
  ENSP ID: ENSP00000398378
MSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 64364 - protein, 770 aa, Homo sapiens
  Payload ID: 12840
  Gene Symbol: PMS1
  Gene Name: PMS1 homolog 1, mismatch repair system component
  Uniprot ID: P54277
  ENSP ID: ENSP00000401064
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLNLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 64365 - protein, 667 aa, Homo sapiens
  Payload ID: 12840
  Gene Symbol: PMS1
  Gene Name: PMS1 homolog 1, mismatch repair system component
  ENSP ID: ENSP00000404492
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMEFQLLKITWK

SEQ ID NO: 64366 - protein, 659 aa, Homo sapiens
  Payload ID: 12840
  Gene Symbol: PMS1
  Gene Name: PMS1 homolog 1, mismatch repair system component
  ENSP ID: ENSP00000406225
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMSF

SEQ ID NO: 64367 - protein, 932 aa, Homo sapiens
  Payload ID: 12840
  Gene Symbol: PMS1
  Gene Name: PMS1 homolog 1, mismatch repair system component
  Uniprot ID: P54277
  ENSP ID: ENSP00000406490
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 64368 - protein, 194 aa, Homo sapiens
  Payload ID: 12840
  Gene Symbol: PMS1
  Gene Name: PMS1 homolog 1, mismatch repair system component
  ENSP ID: ENSP00000410082
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNK

SEQ ID NO: 64369 - protein, 47 aa, Homo sapiens
  Payload ID: 12840
  Gene Symbol: PMS1
  Gene Name: PMS1 homolog 1, mismatch repair system component
  ENSP ID: ENSP00000411151
MKQLPAATVRLLSSSQIITSVVSVVKELIENSLDAGATSVDVKLVQL

SEQ ID NO: 64370 - protein, 44 aa, Homo sapiens
  Payload ID: 12840
  Gene Symbol: PMS1
  Gene Name: PMS1 homolog 1, mismatch repair system component
  ENSP ID: ENSP00000413837
MKQLPAATVRLLSSSQIITSVVSVVKELIENSLDAGATSVDVKL

SEQ ID NO: 64371 - protein, 248 aa, Homo sapiens
  Payload ID: 12840
  Gene Symbol: PMS1
  Gene Name: PMS1 homolog 1, mismatch repair system component
  ENSP ID: ENSP00000480632
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKGEAVRLSRQLPMYLSKEDIQDIIYRMKHQFGNEIKECVHGRPFFHHLTYLPETT

SEQ ID NO: 64372 - protein, 756 aa, Homo sapiens; identical to SEQ ID NO: 64363
  Payload ID: 12840
  Gene Symbol: PMS1
  Gene Name: PMS1 homolog 1, mismatch repair system component
  ENSP ID: ENSP00000485312

SEQ ID NO: 64373 - protein, 862 aa, Homo sapiens
  Payload ID: 12841
  Gene Symbol: PMS2
  Gene Name: PMS1 homolog 2, mismatch repair system component
  Uniprot ID: P54278
  ENSP ID: ENSP00000265849
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 64374 - protein, 461 aa, Homo sapiens
  Payload ID: 12841
  Gene Symbol: PMS2
  Gene Name: PMS1 homolog 2, mismatch repair system component
  Uniprot ID: P54278
  ENSP ID: ENSP00000371758
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 64375 - protein, 756 aa, Homo sapiens
  Payload ID: 12841
  Gene Symbol: PMS2
  Gene Name: PMS1 homolog 2, mismatch repair system component
  ENSP ID: ENSP00000392843
MWGRRRKLRRLNDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 64376 - protein, 805 aa, Homo sapiens
  Payload ID: 12842
  Gene Symbol: PNISR
  Gene Name: PNN-interacting serine/arginine-rich protein
  Uniprot ID: Q8TF01
  ENSP ID: ENSP00000358242
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 64377 - protein, 805 aa, Homo sapiens; identical to SEQ ID NO: 64376
  Payload ID: 12842
  Gene Symbol: PNISR
  Gene Name: PNN-interacting serine/arginine-rich protein
  Uniprot ID: Q8TF01
  ENSP ID: ENSP00000387997

SEQ ID NO: 64378 - protein, 413 aa, Homo sapiens
  Payload ID: 12842
  Gene Symbol: PNISR
  Gene Name: PNN-interacting serine/arginine-rich protein
  Uniprot ID: Q8TF01
  ENSP ID: ENSP00000435246
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKGIFWCFWFCFSWGILVLMTILAFFCCPCWISTRYLNILLHVLTLKD

SEQ ID NO: 64379 - protein, 407 aa, Homo sapiens
  Payload ID: 12843
  Gene Symbol: POC1A
  Gene Name: POC1 centriolar protein A
  Uniprot ID: Q8NBT0
  ENSP ID: ENSP00000296484
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 64380 - protein, 359 aa, Homo sapiens
  Payload ID: 12843
  Gene Symbol: POC1A
  Gene Name: POC1 centriolar protein A
  Uniprot ID: Q8NBT0
  ENSP ID: ENSP00000378421
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLTVSILEQRLTLTEDKLKQCLENQQLIMQRATP

SEQ ID NO: 64381 - protein, 369 aa, Homo sapiens
  Payload ID: 12843
  Gene Symbol: POC1A
  Gene Name: POC1 centriolar protein A
  Uniprot ID: Q8NBT0
  ENSP ID: ENSP00000418968
MDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 64382 - protein, 478 aa, Homo sapiens [sequence omitted]

SEQ ID NO: 64383 - protein, 348 aa, Homo sapiens
  Payload ID: 12844
  Gene Symbol: POC1B
  Gene Name: POC1 centriolar protein B
  ENSP ID: ENSP00000376877
MYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 64384 - protein, 50 aa, Homo sapiens
  Payload ID: 12844
  Gene Symbol: POC1B
  Gene Name: POC1 centriolar protein B
  ENSP ID: ENSP00000447437
MASATEDPVLERYFKGHKAAITSLDLSPNGKQLGEENSQNLKLIQLQFEV

SEQ ID NO: 64385 - protein, 436 aa, Homo sapiens
  Payload ID: 12844
  Gene Symbol: POC1B
  Gene Name: POC1 centriolar protein B
  Uniprot ID: Q8TC44
  ENSP ID: ENSP00000447916
MLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 64386 - protein, 91 aa, Homo sapiens
  Payload ID: 12844
  Gene Symbol: POC1B
  Gene Name: POC1 centriolar protein B
  ENSP ID: ENSP00000449256
MASATEDPVLERYFKGHKAAITSLDLSPNGKQLATASWDTFLMLWNFKPHARAYRYVGHKDVVTSVQFSPHGNLLASASRDRTVRLWIPDK

SEQ ID NO: 64387 - protein, 50 aa, Homo sapiens; identical to SEQ ID NO: 64384
  Payload ID: 12844
  Gene Symbol: POC1B
  Gene Name: POC1 centriolar protein B
  ENSP ID: ENSP00000449648

SEQ ID NO: 64388 - protein, 50 aa, Homo sapiens; identical to SEQ ID NO: 64384
  Payload ID: 12844
  Gene Symbol: POC1B
  Gene Name: POC1 centriolar protein B
  ENSP ID: ENSP00000449945

SEQ ID NO: 64389 - protein, 93 aa, Homo sapiens
  Payload ID: 12844
  Gene Symbol: POC1B
  Gene Name: POC1 centriolar protein B
  ENSP ID: ENSP00000450118
MYRQRFLYSLYRHTHWVRCAKDLSLLFHFQKVESYLHQEVQTHRSYYGGLTLMNCIVKVLPKEISKDYILIHHHIFLISTQEHHIPMRKKLRL

SEQ ID NO: 64390 - protein, 42 aa, Homo sapiens
  Payload ID: 12845
  Gene Symbol: POC1B-GALNT4
  Gene Name: POC1B-GALNT4 readthrough
  ENSP ID: ENSP00000447754
MASATEDPVLERYFKGHKAAITSLDLSPNGKQLGKGQADIKN

SEQ ID NO: 64391 - protein, 575 aa, Homo sapiens
  Payload ID: 12845
  Gene Symbol: POC1B-GALNT4
  Gene Name: POC1B-GALNT4 readthrough
  ENSP ID: ENSP00000447852
MASATEDPVLERYFKGHKAAITSLDLSPNGKQLGAGRARELGSRRLSDLQKNTEDLSRPLYKKPPADSRALGEWGKASKLQLNEDELKQQEELIERYAINIYLSDRISLHRHIEDKRMYECKSQKFNYRTLPTTSVIIAFYNEAWSTLLRTIHSVLETSPAVLLKEIILVDDLSDRVYLKTQLETYISNLDRVRLIRTNKREGLVRARLIGATFATGDVLTFLDCHCECNSGWLEPLLERIGRDETAVVCPVIDTIDWNTFEFYMQIGEPMIGGFDWRLTFQWHSVPKQERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 64392 - protein, 550 aa, Homo sapiens
  Payload ID: 12846
  Gene Symbol: POC5
  Gene Name: POC5 centriolar protein
  Uniprot ID: Q8NA72
  ENSP ID: ENSP00000399481
MKWEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 64393 - protein, 575 aa, Homo sapiens
  Payload ID: 12846
  Gene Symbol: POC5
  Gene Name: POC5 centriolar protein
  Uniprot ID: Q8NA72
  ENSP ID: ENSP00000410216
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 64394 - protein, 547 aa, Homo sapiens
  Payload ID: 12846
  Gene Symbol: POC5
  Gene Name: POC5 centriolar protein
  ENSP ID: ENSP00000420971
MSSDEEKYSLPVVQNDSSRGSSVSSNLQEEYEELLHYAIVTPNIEPCASQSSHPKGELVPDVRISTIHDILHSQESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 64395 - protein, 162 aa, Homo sapiens
  Payload ID: 12846
  Gene Symbol: POC5
  Gene Name: POC5 centriolar protein
  ENSP ID: ENSP00000424264
MDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRT

SEQ ID NO: 64396 - protein, 32 aa, Homo sapiens
  Payload ID: 12846
  Gene Symbol: POC5
  Gene Name: POC5 centriolar protein
  ENSP ID: ENSP00000425108
MDFFSSHLLADSSSPATNSSHTDAHEILVSDF

SEQ ID NO: 64397 - protein, 50 aa, Homo sapiens
  Payload ID: 12846
  Gene Symbol: POC5
  Gene Name: POC5 centriolar protein
  ENSP ID: ENSP00000425726
MDFFSSHLLADSSSPATNSSHTDAHEILVSDFLVSDENLQKMENVLDLWS

SEQ ID NO: 64398 - protein, 58 aa, Homo sapiens
  Payload ID: 12846
  Gene Symbol: POC5
  Gene Name: POC5 centriolar protein
  ENSP ID: ENSP00000425885
MSSDEEKYSLPVVQNDSSRGSSVSSNLQKILMNSSYTLYKGFNQHSKRKNMKNCFIML

SEQ ID NO: 64399 - protein, 399 aa, Homo sapiens
  Payload ID: 12846
  Gene Symbol: POC5
  Gene Name: POC5 centriolar protein
  Uniprot ID: Q8NA72
  ENSP ID: ENSP00000426796
MDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMQTIPQATAAKYPRTIHPESSTSASRSLGTRSAHTQSLTSVHSIKVVD

SEQ ID NO: 64400 - protein, 526 aa, Homo sapiens
  Payload ID: 12847
  Gene Symbol: PODXL
  Gene Name: podocalyxin-like
  Uniprot ID: O00592
  ENSP ID: ENSP00000319782
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 64401 - protein, 558 aa, Homo sapiens
  Payload ID: 12847
  Gene Symbol: PODXL
  Gene Name: podocalyxin-like
  Uniprot ID: O00592
  ENSP ID: ENSP00000367817
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 64402 - protein, 324 aa, Homo sapiens
  Payload ID: 12847
  Gene Symbol: PODXL
  Gene Name: podocalyxin-like
  ENSP ID: ENSP00000390152
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWVTPAGVGQVGEPRLG

SEQ ID NO: 64403 - protein, 605 aa, Homo sapiens
  Payload ID: 12848
  Gene Symbol: PODXL2
  Gene Name: podocalyxin-like 2
  Uniprot ID: Q9NZ53
  ENSP ID: ENSP00000345359
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 64404 - protein, 661 aa, Homo sapiens
  Payload ID: 12849
  Gene Symbol: PODN
  Gene Name: podocan
  Uniprot ID: Q7Z5L7
  ENSP ID: ENSP00000308315
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLAPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 64405 - protein, 642 aa, Homo sapiens
  Payload ID: 12849
  Gene Symbol: PODN
  Gene Name: podocan
  Uniprot ID: Q7Z5L7
  ENSP ID: ENSP00000360555
MEGEEAEQPAWFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLAPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 64406 - protein, 519 aa, Homo sapiens
  Payload ID: 12849
  Gene Symbol: PODN
  Gene Name: podocan
  Uniprot ID: Q7Z5L7
  ENSP ID: ENSP00000379212
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 64407 - protein, 642 aa, Homo sapiens; identical to SEQ ID NO: 64405
  Payload ID: 12849
  Gene Symbol: PODN
  Gene Name: podocan
  Uniprot ID: Q7Z5L7
  ENSP ID: ENSP00000479233

SEQ ID NO: 64408 - protein, 430 aa, Homo sapiens
  Payload ID: 12850
  Gene Symbol: PODNL1
  Gene Name: podocan-like 1
  ENSP ID: ENSP00000254320
MAWTFECSRTTSPEPLSTSPCRTTSSRNSPTMSCPASVACEPSTSTTTSSPPKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 64409 - protein, 512 aa, Homo sapiens
  Payload ID: 12850
  Gene Symbol: PODNL1
  Gene Name: podocan-like 1
  Uniprot ID: Q6PEZ8
  ENSP ID: ENSP00000345175
MAESGLAMWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 64410 - protein, 421 aa, Homo sapiens
  Payload ID: 12850
  Gene Symbol: PODNL1
  Gene Name: podocan-like 1
  Uniprot ID: Q6PEZ8
  ENSP ID: ENSP00000440080
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 64411 - protein, 510 aa, Homo sapiens
  Payload ID: 12850
  Gene Symbol: PODNL1
  Gene Name: podocan-like 1
  Uniprot ID: Q6PEZ8
  ENSP ID: ENSP00000442553
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 64412 - protein, 182 aa, Homo sapiens
  Payload ID: 12850
  Gene Symbol: PODNL1
  Gene Name: podocan-like 1
  ENSP ID: ENSP00000464972
  MOD_RES (1)..(1): Any amino acid
XFESLTQLQHLCVAHNKLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLY

SEQ ID NO: 64413 - protein, 123 aa, Homo sapiens
  Payload ID: 12850
  Gene Symbol: PODNL1
  Gene Name: podocan-like 1
  ENSP ID: ENSP00000466659
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEEQSHLQGAPRSP

SEQ ID NO: 64414 - protein, 238 aa, Homo sapiens
  Payload ID: 12850
  Gene Symbol: PODNL1
  Gene Name: podocan-like 1
  ENSP ID: ENSP00000467395
  MOD_RES (1)..(1): Any amino acid
XYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRANRLHMTSIAAEAFLGLPNLRVVDTAGNPEQVLIRLPPTTPRGPRAGGP

SEQ ID NO: 64415 - protein, 32 aa, Homo sapiens
  Payload ID: 12850
  Gene Symbol: PODNL1
  Gene Name: podocan-like 1
  ENSP ID: ENSP00000467495
MAWTFECSRTTSPEPLSTSPCRTTSSRNSPTM

SEQ ID NO: 64416 - protein, 164 aa, Homo sapiens
  Payload ID: 12850
  Gene Symbol: PODNL1
  Gene Name: podocan-like 1
  ENSP ID: ENSP00000468151
MAWTFECSRTTSPEPLSTSPCRTTSSRNSPTMSCPASVACEPSTSTTTSSPPKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRP

SEQ ID NO: 64417 - protein, 151 aa, Homo sapiens
  Payload ID: 12850
  Gene Symbol: PODNL1
  Gene Name: podocan-like 1
  ENSP ID: ENSP00000468225
RRLPRLRGHRHPQPLQQPAQLPAAQPAALTRAAPPAGSPANNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRP

SEQ ID NO: 64418 - protein, 135 aa, Homo sapiens
  Payload ID: 12850
  Gene Symbol: PODNL1
  Gene Name: podocan-like 1
  ENSP ID: ENSP00000468630
LQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRCPEGDRRGGGGQGRAWEGHDRLSVQGQQASHDEHRG

SEQ ID NO: 64419 - protein, 238 aa, Homo sapiens
  Payload ID: 12851
  Gene Symbol: PDPN
  Gene Name: podoplanin
  Uniprot ID: Q86YL7
  ENSP ID: ENSP00000294489
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 64420 - protein, 236 aa, Homo sapiens
  Payload ID: 12851
  Gene Symbol: PDPN
  Gene Name: podoplanin
  Uniprot ID: Q86YL7
  ENSP ID: ENSP00000365225
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 64421 - protein, 120 aa, Homo sapiens
  Payload ID: 12851
  Gene Symbol: PDPN
  Gene Name: podoplanin
  Uniprot ID: Q86YL7
  ENSP ID: ENSP00000365229
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 64422 - protein, 94 aa, Homo sapiens
  Payload ID: 12851
  Gene Symbol: PDPN
  Gene Name: podoplanin
  ENSP ID: ENSP00000421742
  MOD_RES (1)..(1): Any amino acid
XTAKFAVRLPRVWEARAPSLSGAPAPTPPAPPPSRSSRLGLWPRCFLIFPQLRILLLGPQESNNSTGTMWKVSALLFVLGSASLWVLAEGGEGV

SEQ ID NO: 64423 - protein, 157 aa, Homo sapiens
  Payload ID: 12851
  Gene Symbol: PDPN
  Gene Name: podoplanin
  ENSP ID: ENSP00000422977
MGTSEQRLAGMPGPGIRASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 64424 - protein, 120 aa, Homo sapiens; identical to SEQ ID NO: 64421
  Payload ID: 12851
  Gene Symbol: PDPN
  Gene Name: podoplanin
  Uniprot ID: Q86YL7
  ENSP ID: ENSP00000425304

SEQ ID NO: 64425 - protein, 118 aa, Homo sapiens
  Payload ID: 12851
  Gene Symbol: PDPN
  Gene Name: podoplanin
  Uniprot ID: Q86YL7
  ENSP ID: ENSP00000426063
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 64426 - protein, 43 aa, Homo sapiens
  Payload ID: 12851
  Gene Symbol: PDPN
  Gene Name: podoplanin
  ENSP ID: ENSP00000426210
MPGAEDDVVTPGTSEDRYKSGLTTLRKWMETHRQQLRKMVCQQ

SEQ ID NO: 64427 - protein, 161 aa, Homo sapiens
  Payload ID: 12851
  Gene Symbol: PDPN
  Gene Name: podoplanin
  ENSP ID: ENSP00000426302
MWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYS

SEQ ID NO: 64428 - protein, 120 aa, Homo sapiens; identical to SEQ ID NO: 64421
  Payload ID: 12851
  Gene Symbol: PDPN
  Gene Name: podoplanin
  Uniprot ID: Q86YL7
  ENSP ID: ENSP00000427537

SEQ ID NO: 64429 - protein, 162 aa, Homo sapiens
  Payload ID: 12851
  Gene Symbol: PDPN
  Gene Name: podoplanin
  Uniprot ID: Q86YL7
  ENSP ID: ENSP00000478125
MWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 64430 - protein, 238 aa, Homo sapiens; identical to SEQ ID NO: 64419
  Payload ID: 12851
  Gene Symbol: PDPN
  Gene Name: podoplanin
  Uniprot ID: Q86YL7
  ENSP ID: ENSP00000479591

SEQ ID NO: 64431 - protein, 609 aa, Homo sapiens
  Payload ID: 12852
  Gene Symbol: POGK
  Gene Name: pogo transposable element with KRAB domain
  Uniprot ID: Q9P215
  ENSP ID: ENSP00000356849
MESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 64432 - protein, 609 aa, Homo sapiens; identical to SEQ ID NO: 64431
  Payload ID: 12852
  Gene Symbol: POGK
  Gene Name: pogo transposable element with KRAB domain
  Uniprot ID: Q9P215
  ENSP ID: ENSP00000356850

SEQ ID NO: 64433 - protein, 209 aa, Homo sapiens
  Payload ID: 12852
  Gene Symbol: POGK
  Gene Name: pogo transposable element with KRAB domain
  ENSP ID: ENSP00000404402
MESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVV

SEQ ID NO: 64434 - protein, 1410 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000271715
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64435 - protein, 1315 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000357856
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64436 - protein, 1357 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000376484
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64437 - protein, 1401 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000386836
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64438 - protein, 8 aa, Homo sapiens
  Payload ID: 12853
  Gene Symbol: POGZ
  Gene Name: pogo transposable element with ZNF domain
  ENSP ID: ENSP00000390156
MADTDLFM

SEQ ID NO: 64439 - protein, 84 aa, Homo sapiens
  Payload ID: 12853
  Gene Symbol: POGZ
  Gene Name: pogo transposable element with ZNF domain
  ENSP ID: ENSP00000395332
MADTDLFMECEEEELEPWQKISDVIEDSVVEDYNSVDKTTTAGNPLVQQGGQPLILTQNPAPGLGTMVTQPVLRPVQVMQNANH

SEQ ID NO: 64440 - protein, 60 aa, Homo sapiens
  Payload ID: 12853
  Gene Symbol: POGZ
  Gene Name: pogo transposable element with ZNF domain
  ENSP ID: ENSP00000403955
  MOD_RES (1)..(1): Any amino acid
XGVTGENSNEVAKLVNTLNTIPSLGQSPGPVVVSNNSSAHGSQRTSGPESSMKVLLPRNG

SEQ ID NO: 64441 - protein, 1366 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000418408
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQPYFPSYVTQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64442 - protein, 1348 aa, Homo sapiens
  Payload ID: 12853
  Gene Symbol: POGZ
  Gene Name: pogo transposable element with ZNF domain
  Uniprot ID: Q7Z3K3
  ENSP ID: ENSP00000431259
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 64443 - protein, 316 aa, Homo sapiens
  Payload ID: 12853
  Gene Symbol: POGZ
  Gene Name: pogo transposable element with ZNF domain
  ENSP ID: ENSP00000432295
VHSPYESTTKCKICEWAFESEPLFLQHMKDTHKPGEMPYVCQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTAT

SEQ ID NO: 64444 - protein, 139 aa, Homo sapiens
  Payload ID: 12853
  Gene Symbol: POGZ
  Gene Name: pogo transposable element with ZNF domain
  ENSP ID: ENSP00000433637
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVT

SEQ ID NO: 64445 - protein, 151 aa, Homo sapiens
  Payload ID: 12853
  Gene Symbol: POGZ
  Gene Name: pogo transposable element with ZNF domain
  ENSP ID: ENSP00000433934
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFIT

SEQ ID NO: 64446 - protein, 109 aa, Homo sapiens
  Payload ID: 12853
  Gene Symbol: POGZ
  Gene Name: pogo transposable element with ZNF domain
  ENSP ID: ENSP00000472860
  MOD_RES (1)..(1): Any amino acid
XNPKLGKASEEEMAEPGWDGGWRTDDYHLVTVAPSFPSPPAVSIASFVTVKRPGVTGENSNEVAKLVNTLNTIPSLGQSPGPVVVSNNSSAHGSQRTSGPESSMKGTIT

SEQ ID NO: 64447 - protein, 44 aa, Homo sapiens
  Payload ID: 12854
  Gene Symbol: PVR
  Gene Name: poliovirus receptor
  ENSP ID: ENSP00000187830
MARAMAAAWPLLLVALLVLSWPPPGTGAQHGGDACVTADLGAAW

SEQ ID NO: 64448 - protein, 364 aa, Homo sapiens
  Payload ID: 12854
  Gene Symbol: PVR
  Gene Name: poliovirus receptor
  Uniprot ID: P15151
  ENSP ID: ENSP00000340870
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKGTEHASASANGHVSYSAVSRENSSSQDPQTEGTR

SEQ ID NO: 64449 - protein, 392 aa, Homo sapiens
  Payload ID: 12854
  Gene Symbol: PVR
  Gene Name: poliovirus receptor
  ENSP ID: ENSP00000383907
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSEHHQSCRN

SEQ ID NO: 64450 - protein, 372 aa, Homo sapiens
  Payload ID: 12854
  Gene Symbol: PVR
  Gene Name: poliovirus receptor
  Uniprot ID: P15151
  ENSP ID: ENSP00000385344
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGTEHASASANGHVSYSAVSRENSSSQDPQTEGTR

SEQ ID NO: 64451 - protein, 417 aa, Homo sapiens
  Payload ID: 12854
  Gene Symbol: PVR
  Gene Name: poliovirus receptor
  ENSP ID: ENSP00000402060
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSTEHASASANGHVSYSAVSRENSSSQDPQTEGTR

SEQ ID NO: 64452 - protein, 70 aa, Homo sapiens
  Payload ID: 12854
  Gene Symbol: PVR
  Gene Name: poliovirus receptor
  ENSP ID: ENSP00000466447
  MOD_RES (1)..(1): Any amino acid
XCKVEHESFEKPQLLTVNLTVYYPPEVSISGYDNNWYLGQNEATLTCDARSNPEPTGYNWSTYRACQRLS

SEQ ID NO: 64453 - protein, 326 aa, Homo sapiens
  Payload ID: 12855
  Gene Symbol: PVRIG
  Gene Name: poliovirus receptor related immunoglobulin domain containing
  Uniprot ID: Q6DKI7
  ENSP ID: ENSP00000316675
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 64454 - protein, 517 aa, Homo sapiens
  Payload ID: 12856
  Gene Symbol: PVRL1
  Gene Name: poliovirus receptor-related 1 (herpesvirus entry mediator C)
  Uniprot ID: Q15223
  ENSP ID: ENSP00000264025
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 64455 - protein, 458 aa, Homo sapiens
  Payload ID: 12856
  Gene Symbol: PVRL1
  Gene Name: poliovirus receptor-related 1 (herpesvirus entry mediator C)
  Uniprot ID: Q15223
  ENSP ID: ENSP00000344974
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEKPRPQRGLGSAARLLAGTVAVFLILVAVLTVFFLYNRQQKSPPETDGAGTDQPLSQKPEPSPSRQSSLVPEDIQVVHLDPGRQQQQEEEDLQKLSLQPPYYDLGVSPSYHPSVRTTEPRGECP

SEQ ID NO: 64456 - protein, 352 aa, Homo sapiens
  Payload ID: 12856
  Gene Symbol: PVRL1
  Gene Name: poliovirus receptor-related 1 (herpesvirus entry mediator C)
  Uniprot ID: Q15223
  ENSP ID: ENSP00000345289
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 64457 - protein, 538 aa, Homo sapiens
  Payload ID: 12857
  Gene Symbol: PVRL2
  Gene Name: poliovirus receptor-related 2 (herpesvirus entry mediator B)
  Uniprot ID: Q92692
  ENSP ID: ENSP00000252483
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 64458 - protein, 479 aa, Homo sapiens
  Payload ID: 12857
  Gene Symbol: PVRL2
  Gene Name: poliovirus receptor-related 2 (herpesvirus entry mediator B)
  Uniprot ID: Q92692
  ENSP ID: ENSP00000252485
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 64459 - protein, 56 aa, Homo sapiens
  Payload ID: 12857
  Gene Symbol: PVRL2
  Gene Name: poliovirus receptor-related 2 (herpesvirus entry mediator B)
  ENSP ID: ENSP00000465511
VIHAVDSLFNTTFVCTVTNAVGMGRAEQEEEPVATGDSTIRKLRCWEMGTPSSGHQ

SEQ ID NO: 64460 - protein, 210 aa, Homo sapiens
  Payload ID: 12857
  Gene Symbol: PVRL2
  Gene Name: poliovirus receptor-related 2 (herpesvirus entry mediator B)
  ENSP ID: ENSP00000465587
  MOD_RES (1)..(1): Any amino acid
XKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRALEDDMESQLDGSLISRRAVYV

SEQ ID NO: 64461 - protein, 54 aa, Homo sapiens
  Payload ID: 12857
  Gene Symbol: PVRL2
  Gene Name: poliovirus receptor-related 2 (herpesvirus entry mediator B)
  ENSP ID: ENSP00000468305
  MOD_RES (1)..(1): Any amino acid
XLQGAEEDEEKCLDTMSCPPWKNGQDPCTLEPQAWGPPSRCLQGHLLWKTFPWI

SEQ ID NO: 64462 - protein, 366 aa, Homo sapiens
  Payload ID: 12858
  Gene Symbol: PVRL3
  Gene Name: poliovirus receptor-related 3
  Uniprot ID: Q9NQS3
  ENSP ID: ENSP00000321514
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISAYNSVASLNC

SEQ ID NO: 64463 - protein, 244 aa, Homo sapiens
  Payload ID: 12858
  Gene Symbol: PVRL3
  Gene Name: poliovirus receptor-related 3
  ENSP ID: ENSP00000417572
  MOD_RES (1)..(1): Any amino acid
XARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLDAPEVSVTGYDGNWFVGRKGVNLKCNADANPPPFKSVWSRLDGQWPDGLLASDNTLHFVHPLTFNYSGVYICKVTNS

SEQ ID NO: 64464 - protein, 549 aa, Homo sapiens
  Payload ID: 12858
  Gene Symbol: PVRL3
  Gene Name: poliovirus receptor-related 3
  Uniprot ID: Q9NQS3
  ENSP ID: ENSP00000418070
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 64465 - protein, 130 aa, Homo sapiens
  Payload ID: 12858
  Gene Symbol: PVRL3
  Gene Name: poliovirus receptor-related 3
  ENSP ID: ENSP00000418327
MACSLGGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKG

SEQ ID NO: 64466 - protein, 17 aa, Homo sapiens
  Payload ID: 12858
  Gene Symbol: PVRL3
  Gene Name: poliovirus receptor-related 3
  ENSP ID: ENSP00000418691
MESTTTSFPNETATIIS

SEQ ID NO: 64467 - protein, 31 aa, Homo sapiens
  Payload ID: 12858
  Gene Symbol: PVRL3
  Gene Name: poliovirus receptor-related 3
  ENSP ID: ENSP00000419829
PEHLPLQTQFKEREVGNLQHSTYYNPGTKTH

SEQ ID NO: 64468 - protein, 168 aa, Homo sapiens
  Payload ID: 12858
  Gene Symbol: PVRL3
  Gene Name: poliovirus receptor-related 3
  ENSP ID: ENSP00000420479
MEAKFSSIWHPGDCFSCKTIDCPPFILLNKLSREDLLHCALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLID

SEQ ID NO: 64469 - protein, 487 aa, Homo sapiens
  Payload ID: 12858
  Gene Symbol: PVRL3
  Gene Name: poliovirus receptor-related 3
  Uniprot ID: Q9NQS3
  ENSP ID: ENSP00000420579
MAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVIDLPPTHKPPPLYEERSPPLPQKDLFQPEHLPLQTQFKEREVGNLQHSNGLNSRSFDYEDENPVGEDGIQQMYPLYNQMCYQDRSPGKHHQNNDPKRVYIDPREHYV

SEQ ID NO: 64470 - protein, 510 aa, Homo sapiens
  Payload ID: 12859
  Gene Symbol: PVRL4
  Gene Name: poliovirus receptor-related 4
  Uniprot ID: Q96NY8
  ENSP ID: ENSP00000356991
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 64471 - protein, 603 aa, Homo sapiens
  Payload ID: 12860
  Gene Symbol: PLK1
  Gene Name: polo-like kinase 1
  Uniprot ID: P53350
  ENSP ID: ENSP00000300093
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 64472 - protein, 105 aa, Homo sapiens
  Payload ID: 12860
  Gene Symbol: PLK1
  Gene Name: polo-like kinase 1
  ENSP ID: ENSP00000459688
MYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNK

SEQ ID NO: 64473 - protein, 58 aa, Homo sapiens
  Payload ID: 12860
  Gene Symbol: PLK1
  Gene Name: polo-like kinase 1
  ENSP ID: ENSP00000460084
MYTLLVGKPPFETSCLKETYLRIKKNEYSIPKHINPVAASLIQKMLQTDPTARPTINE

SEQ ID NO: 64474 - protein, 173 aa, Homo sapiens
  Payload ID: 12860
  Gene Symbol: PLK1
  Gene Name: polo-like kinase 1
  ENSP ID: ENSP00000460266
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRVSVAAGELELPAGQLERPDLELLERVPSKGEPGTWSC

SEQ ID NO: 64475 - protein, 685 aa, Homo sapiens
  Payload ID: 12861
  Gene Symbol: PLK2
  Gene Name: polo-like kinase 2
  Uniprot ID: Q9NYY3
  ENSP ID: ENSP00000274289
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 64476 - protein, 671 aa, Homo sapiens
  Payload ID: 12861
  Gene Symbol: PLK2
  Gene Name: polo-like kinase 2
  ENSP ID: ENSP00000478685
MELLRTITYQPAASTKMCEQALGKGCGADSKKKRPPQPPEESQPPQSQAQVPPAISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 64477 - protein, 646 aa, Homo sapiens
  Payload ID: 12862
  Gene Symbol: PLK3
  Gene Name: polo-like kinase 3
  Uniprot ID: Q9H4B4
  ENSP ID: ENSP00000361275
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 64478 - protein, 970 aa, Homo sapiens
  Payload ID: 12863
  Gene Symbol: PLK4
  Gene Name: polo-like kinase 4
  Uniprot ID: O00444
  ENSP ID: ENSP00000270861
MATCIGEKIEDFKVGNLLGKGSFAGVYRAESIHTGLEVAIKMIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 64479 - protein, 892 aa, Homo sapiens
  Payload ID: 12863
  Gene Symbol: PLK4
  Gene Name: polo-like kinase 4
  ENSP ID: ENSP00000421774
MATCIGEKIEDFKVGNLLGKGSFAGVYRAESIHTGLEVAIKMIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 64480 - protein, 909 aa, Homo sapiens
  Payload ID: 12863
  Gene Symbol: PLK4
  Gene Name: polo-like kinase 4
  ENSP ID: ENSP00000423412
MATCIGEKIEDFKVGNLLGKGSFAGVYRAESIHTGLEVAIKMIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEESSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 64481 - protein, 929 aa, Homo sapiens
  Payload ID: 12863
  Gene Symbol: PLK4
  Gene Name: polo-like kinase 4
  Uniprot ID: O00444
  ENSP ID: ENSP00000423582
MIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 64482 - protein, 938 aa, Homo sapiens
  Payload ID: 12863
  Gene Symbol: PLK4
  Gene Name: polo-like kinase 4
  Uniprot ID: O00444
  ENSP ID: ENSP00000427554
MATCIGEKIEDFKVGNLLGKGSFAGVYRAESIHTGLEVAIKMLYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 64483 - protein, 198 aa, Homo sapiens
  Payload ID: 12863
  Gene Symbol: PLK4
  Gene Name: polo-like kinase 4
  ENSP ID: ENSP00000427568
FRYLVMEIRKILAKISICFQGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKL

SEQ ID NO: 64484 - protein, 299 aa, Homo sapiens
  Payload ID: 12864
  Gene Symbol: PLK5
  Gene Name: polo-like kinase 5
  Uniprot ID: Q496M5
  ENSP ID: ENSP00000465896
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRRVSFSGVPAQLVLSGEGEGLQLTLWEQGSPGTSYSLDVPRSHGCAPTTGQHLHHALRMLQSI

SEQ ID NO: 64485 - protein, 336 aa, Homo sapiens
  Payload ID: 12864
  Gene Symbol: PLK5
  Gene Name: polo-like kinase 5
  Uniprot ID: Q496M5
  ENSP ID: ENSP00000466248
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRREGTLPTPVPPAGPGLCLLRFLASEHALLLLFSNGMVQVSFSGVPAQLVLSGEGEGLQLTLWEQGSPGTSYSLDVPRSHGCAPTTGQHLHHALRMLQSI

SEQ ID NO: 64486 - protein, 336 aa, Homo sapiens; identical to SEQ ID NO: 64485
  Payload ID: 12864
  Gene Symbol: PLK5
  Gene Name: polo-like kinase 5
  Uniprot ID: Q496M5
  ENSP ID: ENSP00000468376

SEQ ID NO: 64487 - protein, 976 aa, Homo sapiens
  Payload ID: 12865
  Gene Symbol: PARG
  Gene Name: poly (ADP-ribose) glycohydrolase
  Uniprot ID: Q86W56
  ENSP ID: ENSP00000384408
MNAGPGCEPCTKRPRWGAATTSPAASDARSFPSRQRRVLDPKDAHVQFRVPPSSPACVPGRAGQHRGSATSLVFKQKTITSWMDTKGIKTAESESLDSKENNNTRIESMMSSVQKDNFYQHNVEKLENVSQLSLDKSPTEKSTQYLNQHQTAAMCKWQNEGKHTEQLLESEPQTVTLVPEQFSNANIDRSPQNDDHSDTDSEENRDNQQFLTTVKLANAKQTTEDEQAREAKSHQKCSKSCDPGEDCASCQQDEIDVVPESPLSDVGSEDVGTGPKNDNKLTRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPRCGIRLPLLRPSANHTVTIRVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 64488 - protein, 83 aa, Homo sapiens
  Payload ID: 12865
  Gene Symbol: PARG
  Gene Name: poly (ADP-ribose) glycohydrolase
  ENSP ID: ENSP00000480645
MNAGPGCEPCTKRPRWGAATTSPAASDARSFPSRQRRVLDPKDAHVQFRVPPSSPACVPGRAGQHRGSATSLVWIVKKTTIQE

SEQ ID NO: 64489 - protein, 77 aa, Homo sapiens
  Payload ID: 12865
  Gene Symbol: PARG
  Gene Name: poly (ADP-ribose) glycohydrolase
  ENSP ID: ENSP00000481064
MNAGPGCEPCTKRPRWGAATTSPAASDARSFPSRQRRVLDPKDAHVQFRVPPSSPACVPGRAGQHRGSATSLDVKNP

SEQ ID NO: 64490 - protein, 976 aa, Homo sapiens; identical to SEQ ID NO: 64487
  Payload ID: 12865
  Gene Symbol: PARG
  Gene Name: poly (ADP-ribose) glycohydrolase
  Uniprot ID: Q86W56
  ENSP ID: ENSP00000484285

SEQ ID NO: 64491 - protein, 155 aa, Homo sapiens
  Payload ID: 12866
  Gene Symbol: PARP1
  Gene Name: poly (ADP-ribose) polymerase 1
  ENSP ID: ENSP00000355755
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGVYILGQHGHSAPTLKLPGGPRLREQSKPPPACPLPHVQIKRMVPMLFQQHLLDSASSVA

SEQ ID NO: 64492 - protein, 108 aa, Homo sapiens
  Payload ID: 12866
  Gene Symbol: PARP1
  Gene Name: poly (ADP-ribose) polymerase 1
  ENSP ID: ENSP00000355757
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTEPPIPCGIEVMGR

SEQ ID NO: 64493 - protein, 1014 aa, Homo sapiens
  Payload ID: 12866
  Gene Symbol: PARP1
  Gene Name: poly (ADP-ribose) polymerase 1
  Uniprot ID: P09874
  ENSP ID: ENSP00000355759
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 64494 - protein, 108 aa, Homo sapiens; identical to SEQ ID NO: 64492
  Payload ID: 12866
  Gene Symbol: PARP1
  Gene Name: poly (ADP-ribose) polymerase 1
  ENSP ID: ENSP00000485852

SEQ ID NO: 64495 - protein, 583 aa, Homo sapiens
  Payload ID: 12867
  Gene Symbol: PARP2
  Gene Name: poly (ADP-ribose) polymerase 2
  Uniprot ID: Q9UGN5
  ENSP ID: ENSP00000250416
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 64496 - protein, 570 aa, Homo sapiens
  Payload ID: 12867
  Gene Symbol: PARP2
  Gene Name: poly (ADP-ribose) polymerase 2
  Uniprot ID: Q9UGN5
  ENSP ID: ENSP00000392972
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 64497 - protein, 110 aa, Homo sapiens
  Payload ID: 12867
  Gene Symbol: PARP2
  Gene Name: poly (ADP-ribose) polymerase 2
  ENSP ID: ENSP00000431867
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQIP

SEQ ID NO: 64498 - protein, 531 aa, Homo sapiens
  Payload ID: 12867
  Gene Symbol: PARP2
  Gene Name: poly (ADP-ribose) polymerase 2
  ENSP ID: ENSP00000432283
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTL

SEQ ID NO: 64499 - protein, 177 aa, Homo sapiens
  Payload ID: 12867
  Gene Symbol: PARP2
  Gene Name: poly (ADP-ribose) polymerase 2
  ENSP ID: ENSP00000445524
  MOD_RES (1)..(1): Any amino acid
XKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEEWEYSAIRTSK

SEQ ID NO: 64500 - protein, 339 aa, Homo sapiens
  Payload ID: 12868
  Gene Symbol: PARP10
  Gene Name: poly (ADP-ribose) polymerase family, member 10
  ENSP ID: ENSP00000314320
MVAMAEAEAGVAVEVRGLPPAVPDELLTLYFENRRRSGGGPVLSWQRLGCGGVLTFREPADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSL

SEQ ID NO: 64501 - protein, 1025 aa, Homo sapiens
  Payload ID: 12868
  Gene Symbol: PARP10
  Gene Name: poly (ADP-ribose) polymerase family, member 10
  Uniprot ID: Q53GL7
  ENSP ID: ENSP00000325618
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTGGDQEDVSLEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGVSVALRGDCTILRGFGAHPARAARHLVALLAGPWDQSLAFPLAASGPTLAGQTLKGPWNNLERLAENTGEFQEVVRAFYDTLDAARSSIRVVRVERVSHPLLQQQYELYRERLLQRCERRPVEQVLYHGTTAPAVPDICAHGFNRSFCGRNATVYGKGVYFARRASLSVQDRYSPPNADGHKAVFVARVLTGDYGQGRRGLRAPPLRGPGHVLLRYDSAVDCICQPSIFVIFHDTQALPTHLITCEHVPRASPDDPSGLPGRSPDT

SEQ ID NO: 64502 - protein, 128 aa, Homo sapiens
  Payload ID: 12868
  Gene Symbol: PARP10
  Gene Name: poly (ADP-ribose) polymerase family, member 10
  ENSP ID: ENSP00000431250
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALAS

SEQ ID NO: 64503 - protein, 1016 aa, Homo sapiens
  Payload ID: 12868
  Gene Symbol: PARP10
  Gene Name: poly (ADP-ribose) polymerase family, member 10
  ENSP ID: ENSP00000431620
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGVSVALRGDCTILRGFGAHPARAARHLVALLAGPWDQSLAFPLAASGPTLAGQTLKGPWNNLERLAENTGEFQEVVRAFYDTLDAARSSIRVVRVERVSHPLLQQQYELYRERLLQRCERRPVEQVLYHGTTAPAVPDICAHGFNRSFCGRNATVYGKGVYFARRASLSVQDRYSPPNADGHKAVFVARVLTGDYGQGRRGLRAPPLRGPGHVLLRYDSAVDCICQPSIFVIFHDTQALPTHLITCEHVPRASPDDPSGLPGRSPDT

SEQ ID NO: 64504 - protein, 172 aa, Homo sapiens
  Payload ID: 12868
  Gene Symbol: PARP10
  Gene Name: poly (ADP-ribose) polymerase family, member 10
  ENSP ID: ENSP00000431818
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQA

SEQ ID NO: 64505 - protein, 144 aa, Homo sapiens
  Payload ID: 12868
  Gene Symbol: PARP10
  Gene Name: poly (ADP-ribose) polymerase family, member 10
  ENSP ID: ENSP00000432204
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSE

SEQ ID NO: 64506 - protein, 764 aa, Homo sapiens
  Payload ID: 12868
  Gene Symbol: PARP10
  Gene Name: poly (ADP-ribose) polymerase family, member 10
  ENSP ID: ENSP00000432733
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTGGDQEDVSLEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGWRGRR

SEQ ID NO: 64507 - protein, 81 aa, Homo sapiens
  Payload ID: 12868
  Gene Symbol: PARP10
  Gene Name: poly (ADP-ribose) polymerase family, member 10
  ENSP ID: ENSP00000433990
MVAMAEAEAGVAVEVRGLPPAVPDELLTLYFENRRRSGGGPVLSWQRLGCGGVLTFREPADAERVLAQADHELHGAQLSLR

SEQ ID NO: 64508 - protein, 135 aa, Homo sapiens
  Payload ID: 12868
  Gene Symbol: PARP10
  Gene Name: poly (ADP-ribose) polymerase family, member 10
  ENSP ID: ENSP00000434005
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRAL

SEQ ID NO: 64509 - protein, 106 aa, Homo sapiens
  Payload ID: 12868
  Gene Symbol: PARP10
  Gene Name: poly (ADP-ribose) polymerase family, member 10
  ENSP ID: ENSP00000434411
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLE

SEQ ID NO: 64510 - protein, 1037 aa, Homo sapiens
  Payload ID: 12868
  Gene Symbol: PARP10
  Gene Name: poly (ADP-ribose) polymerase family, member 10
  ENSP ID: ENSP00000434776
MGCFPTHLMPRPRVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTGGDQEDVSLEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGVSVALRGDCTILRGFGAHPARAARHLVALLAGPWDQSLAFPLAASGPTLAGQTLKGPWNNLERLAENTGEFQEVVRAFYDTLDAARSSIRVVRVERVSHPLLQQQYELYRERLLQRCERRPVEQVLYHGTTAPAVPDICAHGFNRSFCGRNATVYGKGVYFARRASLSVQDRYSPPNADGHKAVFVARVLTGDYGQGRRGLRAPPLRGPGHVLLRYDSAVDCICQPSIFVIFHDTQALPTHLITCEHVPRASPDDPSGLPGRSPDT

SEQ ID NO: 64511 - protein, 83 aa, Homo sapiens
  Payload ID: 12868
  Gene Symbol: PARP10
  Gene Name: poly (ADP-ribose) polymerase family, member 10
  ENSP ID: ENSP00000435161
MVAMAEAEAGVAVEVRGLPPAVPDELLTLYFENRRRSGGGPVLSWQRLGCGGVLTFREPADAERVLAQADHELHGAQLSLRPA

SEQ ID NO: 64512 - protein, 146 aa, Homo sapiens
  Payload ID: 12868
  Gene Symbol: PARP10
  Gene Name: poly (ADP-ribose) polymerase family, member 10
  ENSP ID: ENSP00000435793
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEAG

SEQ ID NO: 64513 - protein, 178 aa, Homo sapiens
  Payload ID: 12868
  Gene Symbol: PARP10
  Gene Name: poly (ADP-ribose) polymerase family, member 10
  ENSP ID: ENSP00000436301
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVV

SEQ ID NO: 64514 - protein, 88 aa, Homo sapiens
  Payload ID: 12868
  Gene Symbol: PARP10
  Gene Name: poly (ADP-ribose) polymerase family, member 10
  ENSP ID: ENSP00000436333
MVAMAEAEAGVAVEVRGLPPAVPDELLTLYFENRRRSGGGPVLSWQRLGCGGVLTFREPADAERVLAQADHELHGAQLSLRPAPPRAP

SEQ ID NO: 64515 - protein, 144 aa, Homo sapiens; identical to SEQ ID NO: 64505
  Payload ID: 12868
  Gene Symbol: PARP10
  Gene Name: poly (ADP-ribose) polymerase family, member 10
  ENSP ID: ENSP00000436697

SEQ ID NO: 64516 - protein, 338 aa, Homo sapiens
  Payload ID: 12869
  Gene Symbol: PARP11
  Gene Name: poly (ADP-ribose) polymerase family, member 11
  Uniprot ID: Q9NR21
  ENSP ID: ENSP00000228820
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 64517 - protein, 46 aa, Homo sapiens
  Payload ID: 12869
  Gene Symbol: PARP11
  Gene Name: poly (ADP-ribose) polymerase family, member 11
  ENSP ID: ENSP00000387481
MKWMTWTRQIPSGAGFTWQNVGSGTCFSRIPTVSVQLAVKISKKAS

SEQ ID NO: 64518 - protein, 239 aa, Homo sapiens
  Payload ID: 12869
  Gene Symbol: PARP11
  Gene Name: poly (ADP-ribose) polymerase family, member 11
  ENSP ID: ENSP00000392392
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKDNMWKL

SEQ ID NO: 64519 - protein, 185 aa, Homo sapiens
  Payload ID: 12869
  Gene Symbol: PARP11
  Gene Name: poly (ADP-ribose) polymerase family, member 11
  ENSP ID: ENSP00000395062
MWEANPEMFHKAEELFSKTTNNEVDDMDTSDTQWGWFYLAECGKWHMFQPDTNSQCSVSSEDIEKSFKTNPCGSISFTTSKFSYKIDFAEMKQMNLTTGKQRLIKRAPFSISAFSYICENEAIPMPPHWENVNTQVPYQLIPLHNQTHEYNEVANLFGKTMDRNRIKRIQRIQNLDLWEFFCRYR

SEQ ID NO: 64520 - protein, 257 aa, Homo sapiens
  Payload ID: 12869
  Gene Symbol: PARP11
  Gene Name: poly (ADP-ribose) polymerase family, member 11
  Uniprot ID: Q9NR21
  ENSP ID: ENSP00000397058
MWEVAHVSEMKQMNLTTGKQRLIKRAPFSISAFSYICENEAIPMPPHWENVNTQVPYQLIPLHNQTHEYNEVANLFGKTMDRNRIKRIQRIQNLDLWEFFCRKKAQLKKKRGVPQINEQMLFHGTSSEFVEAICIHNFDWRINGIHGAVFGKGTYFARDAAYSSRFCKDDIKHGNTFQIHGVSLQQRHLFRTYKSMFLARVLIGDYINGDSKYMRPPSKDGSYVNLYDSCVDDTWNPKIFVVFDANQIYPEYLIDFH

SEQ ID NO: 64521 - protein, 50 aa, Homo sapiens
  Payload ID: 12869
  Gene Symbol: PARP11
  Gene Name: poly (ADP-ribose) polymerase family, member 11
  ENSP ID: ENSP00000399665
MWEANPEMFHKAEELFSKTTNNEVDDMDTSDTQWGWFYLAECGKWHMFQK

SEQ ID NO: 64522 - protein, 257 aa, Homo sapiens; identical to SEQ ID NO: 64520
  Payload ID: 12869
  Gene Symbol: PARP11
  Gene Name: poly (ADP-ribose) polymerase family, member 11
  Uniprot ID: Q9NR21
  ENSP ID: ENSP00000405385

SEQ ID NO: 64523 - protein, 701 aa, Homo sapiens
  Payload ID: 12870
  Gene Symbol: PARP12
  Gene Name: poly (ADP-ribose) polymerase family, member 12
  Uniprot ID: Q9H0J9
  ENSP ID: ENSP00000263549
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 64524 - protein, 173 aa, Homo sapiens
  Payload ID: 12870
  Gene Symbol: PARP12
  Gene Name: poly (ADP-ribose) polymerase family, member 12
  ENSP ID: ENSP00000417606
KLEKLGMSSDLVSRLPTIYRNAHDIKNKSSAPSRVPPLFVPQGTSERKDSSGSVSPNTLSQEEGDQICLYHIRKSCSFQAFVQKNLVYGTTKKVCRRPKYVSPQDVTTMQTCNTKFPGPKSIPDYWDSSALPDPGFQAKRTDAEAERREGRGRAAAVPRHQRHFCGRHLPAEL

SEQ ID NO: 64525 - protein, 420 aa, Homo sapiens
  Payload ID: 12870
  Gene Symbol: PARP12
  Gene Name: poly (ADP-ribose) polymerase family, member 12
  ENSP ID: ENSP00000417730
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQPSFRKTWSMAQLKRFAADPNTCLPRM

SEQ ID NO: 64526 - protein, 45 aa, Homo sapiens
  Payload ID: 12870
  Gene Symbol: PARP12
  Gene Name: poly (ADP-ribose) polymerase family, member 12
  ENSP ID: ENSP00000418105
  MOD_RES (1)..(1): Any amino acid
XRKDSSGSVSPNTLSQEEGDQICLYHIRKSCSFQGHGAPCDHCQQ

SEQ ID NO: 64527 - protein, 76 aa, Homo sapiens
  Payload ID: 12870
  Gene Symbol: PARP12
  Gene Name: poly (ADP-ribose) polymerase family, member 12
  ENSP ID: ENSP00000418640
  MOD_RES (1)..(1): Any amino acid
XERVQNLALWEVYQWQKGQMQKQNGGKAVDERQLFHGTSAIFVDAICQQNFDWRVCGVHGTSYGKGRWHILSPFTL

SEQ ID NO: 64528 - protein, 1801 aa, Homo sapiens
  Payload ID: 12871
  Gene Symbol: PARP14
  Gene Name: poly (ADP-ribose) polymerase family, member 14
  Uniprot ID: Q460N5
  ENSP ID: ENSP00000418194
MAVPGSFPLLVEGSWGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDVSEELDTKLPLDGGLDKMEDIPEECENISSLVAFENLKANVTDIMLILLVENISGLSNDDFQVEIIRDFDVAVVTFQKHIDTIRFVDDCTKHHSIKQLQLSPRLLEVTNTIRVENLPPGADDYSLKLFFENPYNGGGRVANVEYFPEESSALIEFFDRKVLDTIMATKLDFNKMPLSVFPYYASLGTALYGKEKPLIKLPAPFEESLDLPLWKFLQKKNHLIEEINDEMRRCHCELTWSQLSGKVTIRPAATLVNEGRPRIKTWQADTSTTLSSIRSKYKVNPIKVDPTMWDTIKNDVKDDRILIEFDTLKEMVILAGKSEDVQSIEVQVRELIESTTQKIKREEQSLKEKMIISPGRYFLLCHSSLLDHLLTECPEIEICYDRVTQHLCLKGPSADVYKAKCEIQEKVYTMAQKNIQVSPEIFQFLQQVNWKEFSKCLFIAQKILALYELEGTTVLLTSCSSEALLEAEKQMLSALNYKRIEVENKEVLHGKKWKGLTHNLLKKQNSSPNTVIINELTSETTAEVIITGCVKEVNETYKLLFNFVEQNMKIERLVEVKPSLVIDYLKTEKKLFWPKIKKVNVQVSFNPENKQKGILLTGSKTEVLKAVDIVKQVWDSVCVKSVHTDKPGAKQFFQDKARFYQSEIKRLFGCYIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 64529 - protein, 194 aa, Homo sapiens
  Payload ID: 12871
  Gene Symbol: PARP14
  Gene Name: poly (ADP-ribose) polymerase family, member 14
  ENSP ID: ENSP00000418535
  MOD_RES (1)..(1): Any amino acid
XVRRRAELRMAVPGSFPLLVEGSWGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDTIRFVDDCTKHHSIKQLQLSPRLLEVTNTIRVENLPPGADDYSLKLFFENPYNGGGRVANVEYFPE

SEQ ID NO: 64530 - protein, 1521 aa, Homo sapiens
  Payload ID: 12871
  Gene Symbol: PARP14
  Gene Name: poly (ADP-ribose) polymerase family, member 14
  ENSP ID: ENSP00000420649
VTDIMLILLVENISGLSNDDFQVEIIRDFDVAVVTFQKHIDTIRFVDDCTKHHSIKQLQLSPRLLEVTNTIRVENLPPGADDYSLKLFFENPYNGGGRVANVEYFPEESSALIEFFDRKVLDTIMATKLDFNKMPLSVFPYYASLGTALYGKEKPLIKLPAPFEESLDLPLWKFLQKKNHLIEEINDEMRRCHCELTWSQLSGKVTIRPAATLVNEGRPRIKTWQADTSTTLSSIRSKYKVNPIKVDPTMWDTIKNDVKDDRILIEFDTLKEMVILAGKSEDVQSIEVQVRELIESTTQKIKREEQSLKEKMIISPGRYFLLCHSSLLDHLLTECPEIEICYDRVTQHLCLKGPSADVYKAKCEIQEKVYTMAQKNIQVSPEIFQFLQQVNWKEFSKCLFIAQKILALYELEGTTVLLTSCSSEALLEAEKQMLSALNYKRIEVENKEVLHGKKWKGLTHNLLKKQNSSPNTVIINELTSETTAEVIITGCVKEVNETYKLLFNFVEQNMKIERLVEVKPSLVIDYLKTEKKLFWPKIKKVNVQVSFNPENKQKGILLTGSKTEVLKAVDIVKQVWDSVCVKSVHTDKPGAKQFFQDKARFYQSEIKRLFGCYIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKVSLLLECSFWMVEISSVMVLYKIHFHSLPITFF

SEQ ID NO: 64531 - protein, 444 aa, Homo sapiens
  Payload ID: 12872
  Gene Symbol: PARP15
  Gene Name: poly (ADP-ribose) polymerase family, member 15
  Uniprot ID: Q460N3
  ENSP ID: ENSP00000308436
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 64532 - protein, 678 aa, Homo sapiens
  Payload ID: 12872
  Gene Symbol: PARP15
  Gene Name: poly (ADP-ribose) polymerase family, member 15
  Uniprot ID: Q460N3
  ENSP ID: ENSP00000417214
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQIMANIIKKCLTTVEVLSFSSITFPMIGTGSLQFPKAVFAKLILSEVFEYSSSTRPITSPLQEVHFLVYTNDDEGCQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 64533 - protein, 483 aa, Homo sapiens
  Payload ID: 12872
  Gene Symbol: PARP15
  Gene Name: poly (ADP-ribose) polymerase family, member 15
  ENSP ID: ENSP00000417785
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 64534 - protein, 375 aa, Homo sapiens
  Payload ID: 12872
  Gene Symbol: PARP15
  Gene Name: poly (ADP-ribose) polymerase family, member 15
  ENSP ID: ENSP00000419488
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 64535 - protein, 323 aa, Homo sapiens
  Payload ID: 12873
  Gene Symbol: PARP16
  Gene Name: poly (ADP-ribose) polymerase family, member 16
  Uniprot ID: Q8N5Y8
  ENSP ID: ENSP00000261888
MQPSGWAAAREAAGRDMLAADLRCSLFASALQSYKRDSVLRPFPASYARGDCKDFEALLADASKLPNLKELLQSSGDNHKRAWDLVSWILSSKVLTIHSAGKAEFEKIQKLTGAPHTPVPAPDFLFEIEYFDPANAKFYETKGERDLIYAFHGSRLENFHSIIHNGLHCHLNKTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKSRASSQLSWFSSHWFTVMISLYLLLLLIVSVINSSAFQHFWNRAKR

SEQ ID NO: 64536 - protein, 207 aa, Homo sapiens
  Payload ID: 12873
  Gene Symbol: PARP16
  Gene Name: poly (ADP-ribose) polymerase family, member 16
  Uniprot ID: Q8N5Y8
  ENSP ID: ENSP00000396118
MQPSGWAAAREAAGRDMLAADLRCSLFASALQSYKRDSVLRPFPASYARGDCKDFEALTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKRASSQLSWFSSHWFTVMISLYLLLLLIVSVINSSAFQHFWNRAKR

SEQ ID NO: 64537 - protein, 72 aa, Homo sapiens
  Payload ID: 12873
  Gene Symbol: PARP16
  Gene Name: poly (ADP-ribose) polymerase family, member 16
  ENSP ID: ENSP00000457982
  MOD_RES (1)..(1): Any amino acid
XRRARIKHSEGGDIPPKYFVVTNNQLLRVKYLLVYSQKPPKRASSQLSWFSSHWFTVMISLYLLLLLIALGI

SEQ ID NO: 64538 - protein, 540 aa, Homo sapiens
  Payload ID: 12874
  Gene Symbol: PARP3
  Gene Name: poly (ADP-ribose) polymerase family, member 3
  Uniprot ID: Q9Y6F1
  ENSP ID: ENSP00000381740
MSLLFLAMAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 64539 - protein, 533 aa, Homo sapiens
  Payload ID: 12874
  Gene Symbol: PARP3
  Gene Name: poly (ADP-ribose) polymerase family, member 3
  ENSP ID: ENSP00000395951
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 64540 - protein, 533 aa, Homo sapiens; identical to SEQ ID NO: 64539
  Payload ID: 12874
  Gene Symbol: PARP3
  Gene Name: poly (ADP-ribose) polymerase family, member 3
  ENSP ID: ENSP00000401511

SEQ ID NO: 64541 - protein, 53 aa, Homo sapiens
  Payload ID: 12874
  Gene Symbol: PARP3
  Gene Name: poly (ADP-ribose) polymerase family, member 3
  ENSP ID: ENSP00000417396
MSLLFLGQPWLQSRSPGYRLRALRRRRAGRQEGRRTPSAPPLRPSRPYPQRSA

SEQ ID NO: 64542 - protein, 331 aa, Homo sapiens
  Payload ID: 12874
  Gene Symbol: PARP3
  Gene Name: poly (ADP-ribose) polymerase family, member 3
  ENSP ID: ENSP00000417625
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNRWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDS

SEQ ID NO: 64543 - protein, 1724 aa, Homo sapiens
  Payload ID: 12875
  Gene Symbol: PARP4
  Gene Name: poly (ADP-ribose) polymerase family, member 4
  Uniprot ID: Q9UKK3
  ENSP ID: ENSP00000371419
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTMAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDVPEALQAPAQVPSLFLNDRLLVYGFIPHCTQATLCALIQEKEFRTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLPPTARAHSPASLSFASYRQVASFGSAAPPRQFDASQFSQGPVPGTCADWIPQSASCPTGPPQNPPSSPYCGIVFSGSSLSSAQSAPLQHPGGFTTRPSAGTFPELDSPQLHFSLPTDPDPIRGFGSYHPSASSPFHFQPSAASLTANLRLPMASALPEALCSQSRTTPVDLCLLEESVGSLEGSRCPVFAFQSSDTESDELSEVLQDSCFLQIKCDTKDDSILCFLEVKEEDEIVCIQHWQDAVPWTELLSLQTEDGFWKLTPELGLILNLNTNGLHSFLKQKGIQSLGVKGRECLLDLIATMLVLQFIRTRLEKEGIVFKSLMKMDDASISRNIPWAFEAIKQASEWVRRTEGQYPSICPRLELGNDWDSATKQLLGLQPISTVSPLHRVLHYSQG

SEQ ID NO: 64544 - protein, 518 aa, Homo sapiens
  Payload ID: 12876
  Gene Symbol: PARP6
  Gene Name: poly (ADP-ribose) polymerase family, member 6
  Uniprot ID: Q2NL67
  ENSP ID: ENSP00000260376
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRLKFMHTSHQFLLLSSPPAKEARFRTAKKLYGSTFAFHGSHIENWHSILRNGLVNASYTKLQEWEKDSTGCPPRMSWSRDTTG

SEQ ID NO: 64545 - protein, 630 aa, Homo sapiens
  Payload ID: 12876
  Gene Symbol: PARP6
  Gene Name: poly (ADP-ribose) polymerase family, member 6
  Uniprot ID: Q2NL67
  ENSP ID: ENSP00000287196
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 64546 - protein, 553 aa, Homo sapiens
  Payload ID: 12876
  Gene Symbol: PARP6
  Gene Name: poly (ADP-ribose) polymerase family, member 6
  ENSP ID: ENSP00000403265
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQ

SEQ ID NO: 64547 - protein, 251 aa, Homo sapiens
  Payload ID: 12876
  Gene Symbol: PARP6
  Gene Name: poly (ADP-ribose) polymerase family, member 6
  ENSP ID: ENSP00000454298
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAVVTARTFPLWSMDSSFRS

SEQ ID NO: 64548 - protein, 17 aa, Homo sapiens
  Payload ID: 12876
  Gene Symbol: PARP6
  Gene Name: poly (ADP-ribose) polymerase family, member 6
  ENSP ID: ENSP00000455637
VMSIREMTQGWGSHMER

SEQ ID NO: 64549 - protein, 564 aa, Homo sapiens
  Payload ID: 12876
  Gene Symbol: PARP6
  Gene Name: poly (ADP-ribose) polymerase family, member 6
  ENSP ID: ENSP00000455815
  MOD_RES (1)..(1): Any amino acid
XEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 64550 - protein, 73 aa, Homo sapiens
  Payload ID: 12876
  Gene Symbol: PARP6
  Gene Name: poly (ADP-ribose) polymerase family, member 6
  ENSP ID: ENSP00000455847
  MOD_RES (1)..(1): Any amino acid
XVCTRELCVFSFYTLGVMSGAAEEVATGAEGSYLEIKKQMDKLDPLAHPLLQWIISSNRSHIVKLPLSRWVPH

SEQ ID NO: 64551 - protein, 630 aa, Homo sapiens; identical to SEQ ID NO: 64545
  Payload ID: 12876
  Gene Symbol: PARP6
  Gene Name: poly (ADP-ribose) polymerase family, member 6
  Uniprot ID: Q2NL67
  ENSP ID: ENSP00000456348

SEQ ID NO: 64552 - protein, 519 aa, Homo sapiens
  Payload ID: 12876
  Gene Symbol: PARP6
  Gene Name: poly (ADP-ribose) polymerase family, member 6
  ENSP ID: ENSP00000456370
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQEWEKDSTGCPPRMSWSRDTTG

SEQ ID NO: 64553 - protein, 451 aa, Homo sapiens
  Payload ID: 12876
  Gene Symbol: PARP6
  Gene Name: poly (ADP-ribose) polymerase family, member 6
  ENSP ID: ENSP00000456468
  MOD_RES (1)..(1): Any amino acid
XEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRLKFMHTSHQFLLLSSPPAKEARFRTAKKLYGSTFAFHGSHIENWHSILRNGLVNASYTKLQEWEKDSTGCPPRMSWSRDTTG

SEQ ID NO: 64554 - protein, 80 aa, Homo sapiens
  Payload ID: 12876
  Gene Symbol: PARP6
  Gene Name: poly (ADP-ribose) polymerase family, member 6
  ENSP ID: ENSP00000456749
  MOD_RES (1)..(1): Any amino acid
XVGRLMNRSISCTMKNPKVEVFGYPPSPQAVVTARTFPLWSMDSSFRYEDGQVGDANINTQDPKIQKEIMRVIGTQVYTN

SEQ ID NO: 64555 - protein, 76 aa, Homo sapiens
  Payload ID: 12876
  Gene Symbol: PARP6
  Gene Name: poly (ADP-ribose) polymerase family, member 6
  ENSP ID: ENSP00000457134
  MOD_RES (1)..(1): Any amino acid
XDNESEEFLYGVQGSCAADLYRHPQLDADIEAVKEIYSENSVSIREYGTIDDVDIDLHINISFLDVSGASTCQQHV

SEQ ID NO: 64556 - protein, 26 aa, Homo sapiens
  Payload ID: 12876
  Gene Symbol: PARP6
  Gene Name: poly (ADP-ribose) polymerase family, member 6
  ENSP ID: ENSP00000457187
MDIKGQFWNDDDSEGDNESEEFLYGV

SEQ ID NO: 64557 - protein, 124 aa, Homo sapiens
  Payload ID: 12876
  Gene Symbol: PARP6
  Gene Name: poly (ADP-ribose) polymerase family, member 6
  ENSP ID: ENSP00000457752
  MOD_RES (1)..(1): Any amino acid
XLCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWNGKRTAQDALQG

SEQ ID NO: 64558 - protein, 73 aa, Homo sapiens
  Payload ID: 12876
  Gene Symbol: PARP6
  Gene Name: poly (ADP-ribose) polymerase family, member 6
  ENSP ID: ENSP00000457862
MDIKGQFWNDDDSEGDNESEEFLYGVQGSCAADLYRHPQLDADIEAVKEIYSENSVSIREYGTIDDVDIDLHI

SEQ ID NO: 64559 - protein, 440 aa, Homo sapiens
  Payload ID: 12876
  Gene Symbol: PARP6
  Gene Name: poly (ADP-ribose) polymerase family, member 6
  ENSP ID: ENSP00000484561
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRWVPH

SEQ ID NO: 64560 - protein, 854 aa, Homo sapiens
  Payload ID: 12877
  Gene Symbol: PARP8
  Gene Name: poly (ADP-ribose) polymerase family, member 8
  Uniprot ID: Q8N3A8
  ENSP ID: ENSP00000281631
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 64561 - protein, 45 aa, Homo sapiens
  Payload ID: 12877
  Gene Symbol: PARP8
  Gene Name: poly (ADP-ribose) polymerase family, member 8
  ENSP ID: ENSP00000421503
MGMCSRQERIQKDIDVVIQKSRAEKDCLFAVYPTQYMYLKITQLL

SEQ ID NO: 64562 - protein, 116 aa, Homo sapiens
  Payload ID: 12877
  Gene Symbol: PARP8
  Gene Name: poly (ADP-ribose) polymerase family, member 8
  ENSP ID: ENSP00000421708
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEV

SEQ ID NO: 64563 - protein, 49 aa, Homo sapiens
  Payload ID: 12877
  Gene Symbol: PARP8
  Gene Name: poly (ADP-ribose) polymerase family, member 8
  ENSP ID: ENSP00000422183
MGMCSRQERIQKDIDVVIQKSRAEKDCLFADFRYSDSTFTFTYVGGPRR

SEQ ID NO: 64564 - protein, 854 aa, Homo sapiens; identical to SEQ ID NO: 64560
  Payload ID: 12877
  Gene Symbol: PARP8
  Gene Name: poly (ADP-ribose) polymerase family, member 8
  Uniprot ID: Q8N3A8
  ENSP ID: ENSP00000422217

SEQ ID NO: 64565 - protein, 91 aa, Homo sapiens
  Payload ID: 12877
  Gene Symbol: PARP8
  Gene Name: poly (ADP-ribose) polymerase family, member 8
  ENSP ID: ENSP00000422288
MGMCSRQERIQKDIDVVIQKSRAEKDCLFADFRYSDSTFTFTYVGGPRSVSYSVHVSEDYPAIVNTATMHMVVEILLQDPGSVSCGSQKDC

SEQ ID NO: 64566 - protein, 133 aa, Homo sapiens
  Payload ID: 12877
  Gene Symbol: PARP8
  Gene Name: poly (ADP-ribose) polymerase family, member 8
  ENSP ID: ENSP00000422355
MGMCSRQERIQKDIDVVIQKSRAEKDCLFADFRYSDSTFTFTYVGGPRSTFLDWLPSGCEKANQQRPELSASSFTSRRSKRLPTGRISFLLPRPGAIARSQLTATSASQVQVILLPQPSTSWHYRNSELAPGM

SEQ ID NO: 64567 - protein, 64 aa, Homo sapiens
  Payload ID: 12877
  Gene Symbol: PARP8
  Gene Name: poly (ADP-ribose) polymerase family, member 8
  ENSP ID: ENSP00000423133
MGMCSRQERIQKDIDVVIQKSRAEKDCLFADFRYSDSTFTFTYVGGPRREYGAIDDVDIDLHID

SEQ ID NO: 64568 - protein, 833 aa, Homo sapiens
  Payload ID: 12877
  Gene Symbol: PARP8
  Gene Name: poly (ADP-ribose) polymerase family, member 8
  ENSP ID: ENSP00000423946
MEPAALRCAYFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 64569 - protein, 253 aa, Homo sapiens
  Payload ID: 12877
  Gene Symbol: PARP8
  Gene Name: poly (ADP-ribose) polymerase family, member 8
  ENSP ID: ENSP00000424485
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPESCRHLLHSSGNRAKKNPIACTIKSCQRRK

SEQ ID NO: 64570 - protein, 812 aa, Homo sapiens
  Payload ID: 12877
  Gene Symbol: PARP8
  Gene Name: poly (ADP-ribose) polymerase family, member 8
  Uniprot ID: Q8N3A8
  ENSP ID: ENSP00000424814
MGMCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 64571 - protein, 57 aa, Homo sapiens
  Payload ID: 12877
  Gene Symbol: PARP8
  Gene Name: poly (ADP-ribose) polymerase family, member 8
  ENSP ID: ENSP00000424916
MGMCSRQERIQKDIDVVIQKSRAEKDCLFAVYPTQYMYLKITQIIHMCQVQRMMKMC

SEQ ID NO: 64572 - protein, 77 aa, Homo sapiens
  Payload ID: 12877
  Gene Symbol: PARP8
  Gene Name: poly (ADP-ribose) polymerase family, member 8
  ENSP ID: ENSP00000426243
MGMCSRQERIQKDIDVVIQKSRAEKDCLFADFRYSDSTFTFTYVGGPRSVSYSVHVSEDYPDNTYVSSSENDEDVLV

SEQ ID NO: 64573 - protein, 96 aa, Homo sapiens
  Payload ID: 12877
  Gene Symbol: PARP8
  Gene Name: poly (ADP-ribose) polymerase family, member 8
  ENSP ID: ENSP00000426679
MGMCSRQERIQKDIDVVIQKSRAEKDCLFADFRYSDSTFTFTYVGGPRSVSYSVHVSEDYPDNTYVSSSENDEDVLVTTEPIPVIFHRIATGIKTE

SEQ ID NO: 64574 - protein, 57 aa, Homo sapiens
  Payload ID: 12877
  Gene Symbol: PARP8
  Gene Name: poly (ADP-ribose) polymerase family, member 8
  ENSP ID: ENSP00000427138
MGMCSRQERIQKDIDVVIQKSRAEKDCLFADFRYSDSTFTFTYVGGPRRNSELAPGM

SEQ ID NO: 64575 - protein, 494 aa, Homo sapiens [sequence omitted]

SEQ ID NO: 64576 - protein, 493 aa, Homo sapiens
  Payload ID: 12877
  Gene Symbol: PARP8
  Gene Name: poly (ADP-ribose) polymerase family, member 8
  ENSP ID: ENSP00000440851
MQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKRTAIPIPAKP

SEQ ID NO: 64577 - protein, 854 aa, Homo sapiens
  Payload ID: 12878
  Gene Symbol: PARP9
  Gene Name: poly (ADP-ribose) polymerase family, member 9
  Uniprot ID: Q8IXQ6
  ENSP ID: ENSP00000353512
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 64578 - protein, 399 aa, Homo sapiens
  Payload ID: 12878
  Gene Symbol: PARP9
  Gene Name: poly (ADP-ribose) polymerase family, member 9
  ENSP ID: ENSP00000417664
MDFSMVAGAAAYNEKSDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 64579 - protein, 710 aa, Homo sapiens
  Payload ID: 12878
  Gene Symbol: PARP9
  Gene Name: poly (ADP-ribose) polymerase family, member 9
  Uniprot ID: Q8IXQ6
  ENSP ID: ENSP00000418894
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCGRCQCLIIGATLWNLVS

SEQ ID NO: 64580 - protein, 819 aa, Homo sapiens
  Payload ID: 12878
  Gene Symbol: PARP9
  Gene Name: poly (ADP-ribose) polymerase family, member 9
  Uniprot ID: Q8IXQ6
  ENSP ID: ENSP00000419001
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 64581 - protein, 819 aa, Homo sapiens; identical to SEQ ID NO: 64580
  Payload ID: 12878
  Gene Symbol: PARP9
  Gene Name: poly (ADP-ribose) polymerase family, member 9
  Uniprot ID: Q8IXQ6
  ENSP ID: ENSP00000419506

SEQ ID NO: 64582 - protein, 115 aa, Homo sapiens
  Payload ID: 12878
  Gene Symbol: PARP9
  Gene Name: poly (ADP-ribose) polymerase family, member 9
  ENSP ID: ENSP00000419626
MDFSMKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVN

SEQ ID NO: 64583 - protein, 479 aa, Homo sapiens
  Payload ID: 12879
  Gene Symbol: PAIP1
  Gene Name: poly(A) binding protein interacting protein 1
  Uniprot ID: Q9H074
  ENSP ID: ENSP00000302768
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 64584 - protein, 367 aa, Homo sapiens
  Payload ID: 12879
  Gene Symbol: PAIP1
  Gene Name: poly(A) binding protein interacting protein 1
  Uniprot ID: Q9H074
  ENSP ID: ENSP00000339622
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 64585 - protein, 400 aa, Homo sapiens
  Payload ID: 12879
  Gene Symbol: PAIP1
  Gene Name: poly(A) binding protein interacting protein 1
  Uniprot ID: Q9H074
  ENSP ID: ENSP00000387729
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 64586 - protein, 266 aa, Homo sapiens
  Payload ID: 12879
  Gene Symbol: PAIP1
  Gene Name: poly(A) binding protein interacting protein 1
  ENSP ID: ENSP00000422084
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRSREQMDRLQEQIFFRLVFENC

SEQ ID NO: 64587 - protein, 351 aa, Homo sapiens
  Payload ID: 12879
  Gene Symbol: PAIP1
  Gene Name: poly(A) binding protein interacting protein 1
  ENSP ID: ENSP00000425084
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDTWMILMMRWTQR

SEQ ID NO: 64588 - protein, 95 aa, Homo sapiens
  Payload ID: 12879
  Gene Symbol: PAIP1
  Gene Name: poly(A) binding protein interacting protein 1
  ENSP ID: ENSP00000425406
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQ

SEQ ID NO: 64589 - protein, 200 aa, Homo sapiens
  Payload ID: 12879
  Gene Symbol: PAIP1
  Gene Name: poly(A) binding protein interacting protein 1
  ENSP ID: ENSP00000425675
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPM

SEQ ID NO: 64590 - protein, 168 aa, Homo sapiens
  Payload ID: 12879
  Gene Symbol: PAIP1
  Gene Name: poly(A) binding protein interacting protein 1
  ENSP ID: ENSP00000425736
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLN

SEQ ID NO: 64591 - protein, 49 aa, Homo sapiens
  Payload ID: 12879
  Gene Symbol: PAIP1
  Gene Name: poly(A) binding protein interacting protein 1
  ENSP ID: ENSP00000426089
NEPTFYTSDGVPFTAADPDYQEKYQELLEREDFFPDYEENGTDLSGILG

SEQ ID NO: 64592 - protein, 9 aa, Homo sapiens
  Payload ID: 12879
  Gene Symbol: PAIP1
  Gene Name: poly(A) binding protein interacting protein 1
  ENSP ID: ENSP00000427410
MGARLCNYL

SEQ ID NO: 64593 - protein, 127 aa, Homo sapiens
  Payload ID: 12880
  Gene Symbol: PAIP2
  Gene Name: poly(A) binding protein interacting protein 2
  Uniprot ID: Q9BPZ3
  ENSP ID: ENSP00000265192
MKDPSRSSTSPSIINEDVIINGHSHEDDNPFAEYMWMENEEEFNRQIEEELWEEEFIERCFQEMLEEEEEHEWFIPARDLPQTMDQIQDQFNDLVISDGSSLEDLVVKSNLNPNAKEFVPGVKYGNI

SEQ ID NO: 64594 - protein, 127 aa, Homo sapiens; identical to SEQ ID NO: 64593
  Payload ID: 12880
  Gene Symbol: PAIP2
  Gene Name: poly(A) binding protein interacting protein 2
  Uniprot ID: Q9BPZ3
  ENSP ID: ENSP00000378275

SEQ ID NO: 64595 - protein, 127 aa, Homo sapiens; identical to SEQ ID NO: 64593
  Payload ID: 12880
  Gene Symbol: PAIP2
  Gene Name: poly(A) binding protein interacting protein 2
  Uniprot ID: Q9BPZ3
  ENSP ID: ENSP00000422508

SEQ ID NO: 64596 - protein, 67 aa, Homo sapiens
  Payload ID: 12880
  Gene Symbol: PAIP2
  Gene Name: poly(A) binding protein interacting protein 2
  ENSP ID: ENSP00000422821
MKDPSRSSTSPSIINEDVIINGHSHEDDNPFAEYMWMENEEEFNRQVKSNLNPNAKEFVPGVKYGNI

SEQ ID NO: 64597 - protein, 93 aa, Homo sapiens
  Payload ID: 12880
  Gene Symbol: PAIP2
  Gene Name: poly(A) binding protein interacting protein 2
  ENSP ID: ENSP00000423084
MKDPSRSSTSPSIINEDVIINGHSHEDDNPFAEYMWMENEEEFNRQIEEELWEEEFIERCFQEMLEEEEEHEWFIPARDLPQTMDQIQDQFND

SEQ ID NO: 64598 - protein, 123 aa, Homo sapiens
  Payload ID: 12881
  Gene Symbol: PAIP2B
  Gene Name: poly(A) binding protein interacting protein 2B
  Uniprot ID: Q9ULR5
  ENSP ID: ENSP00000244221
MNGSNMANTSPSVKSKEDQGLSGHDEKENPFAEYMWMENEEDFNRQVEEELQEQDFLDRCFQEMLDEEDQDWFIPSRDLPQAMGQLQQQLNGLSVSEGHDSEDILSKSNLNPDAKEFIPGEKY

SEQ ID NO: 64599 - protein, 636 aa, Homo sapiens
  Payload ID: 12882
  Gene Symbol: PABPC1
  Gene Name: poly(A) binding protein, cytoplasmic 1
  Uniprot ID: P11940
  ENSP ID: ENSP00000313007
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64600 - protein, 131 aa, Homo sapiens
  Payload ID: 12882
  Gene Symbol: PABPC1
  Gene Name: poly(A) binding protein, cytoplasmic 1
  ENSP ID: ENSP00000427805
  MOD_RES (1)..(1): Any amino acid
XDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKKKPLKQLQK

SEQ ID NO: 64601 - protein, 284 aa, Homo sapiens
  Payload ID: 12882
  Gene Symbol: PABPC1
  Gene Name: poly(A) binding protein, cytoplasmic 1
  ENSP ID: ENSP00000427914
  MOD_RES (1)..(1): Any amino acid
XVVCDENGSKGYGFVHFETQEAAERAIEKMNGMLLNDRKVFVGRFKSRKEREAELGARAKEFTNVYIKNFGEDMDDERLKDLFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQ

SEQ ID NO: 64602 - protein, 169 aa, Homo sapiens
  Payload ID: 12882
  Gene Symbol: PABPC1
  Gene Name: poly(A) binding protein, cytoplasmic 1
  ENSP ID: ENSP00000428021
  MOD_RES (1)..(1): Any amino acid
XASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64603 - protein, 136 aa, Homo sapiens
  Payload ID: 12882
  Gene Symbol: PABPC1
  Gene Name: poly(A) binding protein, cytoplasmic 1
  ENSP ID: ENSP00000428030
PRPAAAAAAATPAVRTVPQYKYAAGVRNPQQHLNAQPQVTMQQPAVHVQGQEPLTASMLASAPPQEQKQMLAMHPTLAGKITGMLLEIDNSELLHMLESPESLRSKVDEAVAVLQAHQAKEAAQKAVNSATGVPTV

SEQ ID NO: 64604 - protein, 187 aa, Homo sapiens
  Payload ID: 12882
  Gene Symbol: PABPC1
  Gene Name: poly(A) binding protein, cytoplasmic 1
  ENSP ID: ENSP00000428190
  MOD_RES (1)..(1): Any amino acid
XNGKQIYVGRAQKKVERQTELKRKFEQMKQDRITRYQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQ

SEQ ID NO: 64605 - protein, 43 aa, Homo sapiens
  Payload ID: 12882
  Gene Symbol: PABPC1
  Gene Name: poly(A) binding protein, cytoplasmic 1
  ENSP ID: ENSP00000428749
MNPSAPSYPMASLYVGDLHPDVTEAMLYEKFSPAGPILSIRVC

SEQ ID NO: 64606 - protein, 183 aa, Homo sapiens
  Payload ID: 12882
  Gene Symbol: PABPC1
  Gene Name: poly(A) binding protein, cytoplasmic 1
  ENSP ID: ENSP00000428840
IRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64607 - protein, 61 aa, Homo sapiens
  Payload ID: 12882
  Gene Symbol: PABPC1
  Gene Name: poly(A) binding protein, cytoplasmic 1
  ENSP ID: ENSP00000428937
MNPSAPSYPMASLYVGDLHPDVTEAMLYEKFSPAGPILSIRVCRDMITRRSLGYAYVNFQQ

SEQ ID NO: 64608 - protein, 165 aa, Homo sapiens
  Payload ID: 12882
  Gene Symbol: PABPC1
  Gene Name: poly(A) binding protein, cytoplasmic 1
  ENSP ID: ENSP00000428948
  MOD_RES (1)..(1): Any amino acid
XRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPCCSCTRSGTFDCFHVGICPSSRAKANVG

SEQ ID NO: 64609 - protein, 38 aa, Homo sapiens
  Payload ID: 12882
  Gene Symbol: PABPC1
  Gene Name: poly(A) binding protein, cytoplasmic 1
  ENSP ID: ENSP00000429032
MNPSAPSYPMASLYVGDLHPDVTEAMLYEKFSPAGPIL

SEQ ID NO: 64610 - protein, 129 aa, Homo sapiens
  Payload ID: 12882
  Gene Symbol: PABPC1
  Gene Name: poly(A) binding protein, cytoplasmic 1
  ENSP ID: ENSP00000429119
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCK

SEQ ID NO: 64611 - protein, 604 aa, Homo sapiens
  Payload ID: 12882
  Gene Symbol: PABPC1
  Gene Name: poly(A) binding protein, cytoplasmic 1
  ENSP ID: ENSP00000429395
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64612 - protein, 591 aa, Homo sapiens
  Payload ID: 12882
  Gene Symbol: PABPC1
  Gene Name: poly(A) binding protein, cytoplasmic 1
  ENSP ID: ENSP00000429594
MITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64613 - protein, 75 aa, Homo sapiens
  Payload ID: 12882
  Gene Symbol: PABPC1
  Gene Name: poly(A) binding protein, cytoplasmic 1
  ENSP ID: ENSP00000429790
MNPSAPSYPMASLYVGDLHPDVTEAMLYEKFSPAGPILSIRVCRDMITRRSLGYAYVNFQQPADAERALDTMNFD

SEQ ID NO: 64614 - protein, 174 aa, Homo sapiens
  Payload ID: 12882
  Gene Symbol: PABPC1
  Gene Name: poly(A) binding protein, cytoplasmic 1
  ENSP ID: ENSP00000429892
  MOD_RES (1)..(1): Any amino acid
XSYPMASLYVGDLHPDVTEAMLYEKFSPAGPILSIRVCRDMITRRSLGYAYVNFQQPADAERALDTMNFDVIKGKPVVCDENGSKGYGFVHFETQEAAERAIEKMNGMLLNDRKVFVGRFKSRKEREAELGARAKEFTNVYIKNFGEDMDDERLKDLFGKFGPALSVKVMTDES

SEQ ID NO: 64615 - protein, 118 aa, Homo sapiens
  Payload ID: 12882
  Gene Symbol: PABPC1
  Gene Name: poly(A) binding protein, cytoplasmic 1
  ENSP ID: ENSP00000430012
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDT

SEQ ID NO: 64616 - protein, 108 aa, Homo sapiens
  Payload ID: 12882
  Gene Symbol: PABPC1
  Gene Name: poly(A) binding protein, cytoplasmic 1
  ENSP ID: ENSP00000430159
MITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAER

SEQ ID NO: 64617 - protein, 42 aa, Homo sapiens
  Payload ID: 12882
  Gene Symbol: PABPC1
  Gene Name: poly(A) binding protein, cytoplasmic 1
  ENSP ID: ENSP00000430716
  MOD_RES (1)..(1): Any amino acid
XMLESPESLRSKVDEAVAVLQAHQAKEAAQKAVNSATGVPTV

SEQ ID NO: 64618 - protein, 522 aa, Homo sapiens
  Payload ID: 12882
  Gene Symbol: PABPC1
  Gene Name: poly(A) binding protein, cytoplasmic 1
  ENSP ID: ENSP00000478108
MLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 64619 - protein, 614 aa, Homo sapiens
  Payload ID: 12883
  Gene Symbol: PABPC1L
  Gene Name: poly(A) binding protein, cytoplasmic 1-like
  Uniprot ID: Q4VXU2
  ENSP ID: ENSP00000217073
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKVMTEGGHSKGFGFVCFSSPEEATKAVTEMNGRIVGTKPLYVALAQRKEERKAILTNQYMQRLSTMRTLSNPLLGSFQQPSSYFLPAMPQPPAQAAYYGCGPVTPTQPAPRWTSQPPRPSCASMVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 64620 - protein, 330 aa, Homo sapiens
  Payload ID: 12883
  Gene Symbol: PABPC1L
  Gene Name: poly(A) binding protein, cytoplasmic 1-like
  Uniprot ID: Q4VXU2
  ENSP ID: ENSP00000217074
MNASGSGYPLASLYVGDLHPDVTEAMLYEKFSPAGPILSIRVCRDVATRRSLGYAYINFQQPADAERALDTMNFEMLKGQPIRIMWSQRDPGLRKSGVGNIFIKNLEDSIDNKALYDTFSTFGNILSCKVACDEHGSRGFGFVHFETHEAAQQAINTMNGMLLNDRKVFVGHFKSRREREAELGARALEFTNIYVKNLPVDVDEQGLQDLFSQFGKMLSVKVMRDNSGHSRCFGFVNFEKHEEAQKAVVHMNGKEVSGRLLYAGRAQKRVERQNELKRRFEQMKQDRLRRYQGVNLYVKNLDDSIDDDKLRKEFSPYGVITSAKKRRQRP

SEQ ID NO: 64621 - protein, 171 aa, Homo sapiens
  Payload ID: 12883
  Gene Symbol: PABPC1L
  Gene Name: poly(A) binding protein, cytoplasmic 1-like
  ENSP ID: ENSP00000217075
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKKRKSSLPWLPKGQCFWLSALRPCKL

SEQ ID NO: 64622 - protein, 614 aa, Homo sapiens; identical to SEQ ID NO: 64619
  Payload ID: 12883
  Gene Symbol: PABPC1L
  Gene Name: poly(A) binding protein, cytoplasmic 1-like
  Uniprot ID: Q4VXU2
  ENSP ID: ENSP00000255136

SEQ ID NO: 64623 - protein, 149 aa, Homo sapiens
  Payload ID: 12883
  Gene Symbol: PABPC1L
  Gene Name: poly(A) binding protein, cytoplasmic 1-like
  ENSP ID: ENSP00000361906
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKISA

SEQ ID NO: 64624 - protein, 134 aa, Homo sapiens
  Payload ID: 12883
  Gene Symbol: PABPC1L
  Gene Name: poly(A) binding protein, cytoplasmic 1-like
  ENSP ID: ENSP00000361909
CKCSSAAHSTYRVQEPAVHIPGQEPLTASMLAAAPLHEQKQMIGTCYLVLKRWSDWMVLSFLPLLLSCDFEGSVSTPLSMMSTPSWLARSRACCWRLTTQSCCSCWSLQNPSMPRKGNPRFHGCQKDSVSGSQP

SEQ ID NO: 64625 - protein, 168 aa, Homo sapiens
  Payload ID: 12883
  Gene Symbol: PABPC1L
  Gene Name: poly(A) binding protein, cytoplasmic 1-like
  ENSP ID: ENSP00000361911
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 64626 - protein, 152 aa, Homo sapiens
  Payload ID: 12883
  Gene Symbol: PABPC1L
  Gene Name: poly(A) binding protein, cytoplasmic 1-like
  ENSP ID: ENSP00000361913
  MOD_RES (1)..(1): Any amino acid
XQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKAQRRKVQRLVKYILALKELSTQNL

SEQ ID NO: 64627 - protein, 174 aa, Homo sapiens [sequence omitted]

SEQ ID NO: 64628 - protein, 330 aa, Homo sapiens; identical to SEQ ID NO: 64620
  Payload ID: 12883
  Gene Symbol: PABPC1L
  Gene Name: poly(A) binding protein, cytoplasmic 1-like
  Uniprot ID: Q4VXU2
  ENSP ID: ENSP00000445661

SEQ ID NO: 64629 - protein, 200 aa, Homo sapiens
  Payload ID: 12884
  Gene Symbol: PABPC1L2A
  Gene Name: poly(A) binding protein, cytoplasmic 1-like 2A
  Uniprot ID: Q5JQF8
  ENSP ID: ENSP00000362618
MASLYVGDLHPEVTEAMLYEKFSPAGPILSIRICRDKITRRSLGYAYVNYQQPVDAKRALETLNFDVIKGRPVRIMWSQRDPSLRKSGVGNVFIKNLGKTIDNKALYNIFSAFGNILSCKVACDEKGPKGYGFVHFQKQESAERAIDVMNGMFLNYRKIFVGRFKSHKEREAERGAWARQSTSADVKDFEEDTDEEATLR

SEQ ID NO: 64630 - protein, 200 aa, Homo sapiens; identical to SEQ ID NO: 64629
  Payload ID: 12885
  Gene Symbol: PABPC1L2B
  Gene Name: poly(A) binding protein, cytoplasmic 1-like 2B
  Uniprot ID: Q5JQF8
  ENSP ID: ENSP00000362621

SEQ ID NO: 64631 - protein, 631 aa, Homo sapiens
  Payload ID: 12886
  Gene Symbol: PABPC3
  Gene Name: poly(A) binding protein, cytoplasmic 3
  Uniprot ID: Q9H361
  ENSP ID: ENSP00000281589
MNPSTPSYPTASLYVGDLHPDVTEAMLYEKFSPAGPILSIRICRDLITSGSSNYAYVNFQHTKDAEHALDTMNFDVIKGKPVRIMWSQRDPSLRKSGVGNIFVKNLDKSINNKALYDTVSAFGNILSCNVVCDENGSKGYGFVHFETHEAAERAIKKMNGMLLNGRKVFVGQFKSRKEREAELGARAKEFPNVYIKNFGEDMDDERLKDLFGKFGPALSVKVMTDESGKSKGFGFVSFERHEDAQKAVDEMNGKELNGKQIYVGRAQKKVERQTELKRTFEQMKQDRITRYQVVNLYVKNLDDGIDDERLRKAFSPFGTITSAKVMMEGGRSKGFGFVCFSSPEEATKAVTEMNGRIVATKPLYVALAQRKEERQAYLTNEYMQRMASVRAVPNQRAPPSGYFMTAVPQTQNHAAYYPPSQIARLRPSPRWTAQGARPHPFQNKPSAIRPGAPRVPFSTMRPASSQVPRVMSTQRVANTSTQTVGPRPAAAAAAAATPAVRTVPRYKYAAGVRNPQQHRNAQPQVTMQQLAVHVQGQETLTASRLASAPPQKQKQMLGERLFPLIQAMHPTLAGKITGMLLEIDNSELLYMLESPESLRSKVDEAVAVLQAHQAKEATQKAVNSATGVPTV

SEQ ID NO: 64632 - protein, 631 aa, Homo sapiens
  Payload ID: 12887
  Gene Symbol: PABPC4
  Gene Name: poly(A) binding protein, cytoplasmic 4 (inducible form)
  Uniprot ID: Q13310
  ENSP ID: ENSP00000361947
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 64633 - protein, 644 aa, Homo sapiens
  Payload ID: 12887
  Gene Symbol: PABPC4
  Gene Name: poly(A) binding protein, cytoplasmic 4 (inducible form)
  Uniprot ID: Q13310
  ENSP ID: ENSP00000361948
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 64634 - protein, 660 aa, Homo sapiens
  Payload ID: 12887
  Gene Symbol: PABPC4
  Gene Name: poly(A) binding protein, cytoplasmic 4 (inducible form)
  Uniprot ID: Q13310
  ENSP ID: ENSP00000361949
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 64635 - protein, 615 aa, Homo sapiens
  Payload ID: 12887
  Gene Symbol: PABPC4
  Gene Name: poly(A) binding protein, cytoplasmic 4 (inducible form)
  ENSP ID: ENSP00000361953
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 64636 - protein, 550 aa, Homo sapiens
  Payload ID: 12887
  Gene Symbol: PABPC4
  Gene Name: poly(A) binding protein, cytoplasmic 4 (inducible form)
  ENSP ID: ENSP00000398267
  MOD_RES (1)..(1): Any amino acid
XNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 64637 - protein, 129 aa, Homo sapiens
  Payload ID: 12887
  Gene Symbol: PABPC4
  Gene Name: poly(A) binding protein, cytoplasmic 4 (inducible form)
  ENSP ID: ENSP00000406675
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCK

SEQ ID NO: 64638 - protein, 195 aa, Homo sapiens
  Payload ID: 12887
  Gene Symbol: PABPC4
  Gene Name: poly(A) binding protein, cytoplasmic 4 (inducible form)
  ENSP ID: ENSP00000408559
  MOD_RES (1)..(1): Any amino acid
XRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKDSKAK

SEQ ID NO: 64639 - protein, 197 aa, Homo sapiens
  Payload ID: 12887
  Gene Symbol: PABPC4
  Gene Name: poly(A) binding protein, cytoplasmic 4 (inducible form)
  ENSP ID: ENSP00000431383
  MOD_RES (1)..(1): Any amino acid
XFGNILSCKRQGLHCPTIWLQRSSCFGLPKHWDYRHEPQHPIVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLK

SEQ ID NO: 64640 - protein, 112 aa, Homo sapiens
  Payload ID: 12887
  Gene Symbol: PABPC4
  Gene Name: poly(A) binding protein, cytoplasmic 4 (inducible form)
  ENSP ID: ENSP00000436391
  MOD_RES (1)..(1): Any amino acid
XNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKV

SEQ ID NO: 64641 - protein, 68 aa, Homo sapiens
  Payload ID: 12887
  Gene Symbol: PABPC4
  Gene Name: poly(A) binding protein, cytoplasmic 4 (inducible form)
  ENSP ID: ENSP00000436407
  MOD_RES (1)..(1): Any amino acid
XLIQTMHSNLAGKITGMLLEIDNSELLHMLESPESLRSKVDEAVAVLQAHHAKKEAAQKVGAVAAATS

SEQ ID NO: 64642 - protein, 249 aa, Homo sapiens
  Payload ID: 12887
  Gene Symbol: PABPC4
  Gene Name: poly(A) binding protein, cytoplasmic 4 (inducible form)
  ENSP ID: ENSP00000436566
  MOD_RES (1)..(1): Any amino acid
XELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGFQGMPSAIRQSGPRPTLRHLAPTGNAPASRGLPTTTQRVGVPTAVQNLAPRAAVAAAAPRAVAPYKYASSVRSPHPAIQPLQ

SEQ ID NO: 64643 - protein, 4 aa, Homo sapiens
  Payload ID: 12887
  Gene Symbol: PABPC4
  Gene Name: poly(A) binding protein, cytoplasmic 4 (inducible form)
  ENSP ID: ENSP00000436698
MNAA

SEQ ID NO: 64644 - protein, 370 aa, Homo sapiens
  Payload ID: 12888
  Gene Symbol: PABPC4L
  Gene Name: poly(A) binding protein, cytoplasmic 4-like
  Uniprot ID: P0CB38
  ENSP ID: ENSP00000463233
MNVAAKYRMASLYVGDLHADVTEDLLFRKFSTVGPVLSIRICRDQVTRRSLGYAYVNFLQLADAQKALDTMNFDIIKGKSIRLMWSQRDAYLRRSGIGNVFIKNLDKSIDNKTLYEHFSAFGKILSSKVMSDDQGSKGYAFVHFQNQSAADRAIEEMNGKLLKGCKVFVGRFKNRKDREAELRSKASEFTNVYIKNFGGDMDDERLKDVFSKYGKTLSVKVMTDSSGKSKGFGFVSFDSHEAAKKAVEEMNGRDINGQLIFVGRAQKKVERQAELKQMFEQLKRERIRGCQGVKLYIKNLDDTIDDEKLRNEFSSFGSISRVKVMQEEGQSKGFGLICFSSPEDATKAMTEMNGRILGSKPLSIALAQRH

SEQ ID NO: 64645 - protein, 382 aa, Homo sapiens
  Payload ID: 12889
  Gene Symbol: PABPC5
  Gene Name: poly(A) binding protein, cytoplasmic 5
  Uniprot ID: Q96DU9
  ENSP ID: ENSP00000308012
MGSGEPNPAGKKKKYLKAALYVGDLDPDVTEDMLYKKFRPAGPLRFTRICRDPVTRSPLGYGYVNFRFPADAEWALNTMNFDLINGKPFRLMWSQPDDRLRKSGVGNIFIKNLDKSIDNRALFYLFSAFGNILSCKVVCDDNGSKGYAYVHFDSLAAANRAIWHMNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 64646 - protein, 218 aa, Homo sapiens
  Payload ID: 12889
  Gene Symbol: PABPC5
  Gene Name: poly(A) binding protein, cytoplasmic 5
  ENSP ID: ENSP00000362197
MNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 64647 - protein, 306 aa, Homo sapiens
  Payload ID: 12890
  Gene Symbol: PABPN1
  Gene Name: poly(A) binding protein, nuclear 1
  Uniprot ID: Q86U42
  ENSP ID: ENSP00000216727
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 64648 - protein, 296 aa, Homo sapiens
  Payload ID: 12890
  Gene Symbol: PABPN1
  Gene Name: poly(A) binding protein, nuclear 1
  Uniprot ID: Q86U42
  ENSP ID: ENSP00000380446
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRSG

SEQ ID NO: 64649 - protein, 168 aa, Homo sapiens
  Payload ID: 12890
  Gene Symbol: PABPN1
  Gene Name: poly(A) binding protein, nuclear 1
  ENSP ID: ENSP00000450724
MEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRSG

SEQ ID NO: 64650 - protein, 96 aa, Homo sapiens
  Payload ID: 12890
  Gene Symbol: PABPN1
  Gene Name: poly(A) binding protein, nuclear 1
  ENSP ID: ENSP00000451592
  MOD_RES (1)..(1): Any amino acid
XTILCDKFSGHPKGFAYIEFSDKESVRTSLALDESLFRGRQIKVIPKRTNRPGISTTDRGFPRARYRARTTNYNSSRSRFYSGFNSRPRGRVYRSG

SEQ ID NO: 64651 - protein, 178 aa, Homo sapiens
  Payload ID: 12890
  Gene Symbol: PABPN1
  Gene Name: poly(A) binding protein, nuclear 1
  ENSP ID: ENSP00000451970
MEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 64652 - protein, 255 aa, Homo sapiens
  Payload ID: 12891
  Gene Symbol: PABPN1L
  Gene Name: poly(A) binding protein, nuclear 1-like (cytoplasmic)
  Uniprot ID: A6NDY0
  ENSP ID: ENSP00000405259
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNVDYGGSAEELEAHFSRCGEVHRVTILCDKFSGHPKGCCRKEPTSLGSAPQTAGAFEDTQAPGGHPSPTAASRAGPGSDHKGRTGPVENSHHGFHRIKGKTRF

SEQ ID NO: 64653 - protein, 278 aa, Homo sapiens
  Payload ID: 12891
  Gene Symbol: PABPN1L
  Gene Name: poly(A) binding protein, nuclear 1-like (cytoplasmic)
  Uniprot ID: A6NDY0
  ENSP ID: ENSP00000408598
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNVDYGGSAEELEAHFSRCGEVHRVTILCDKFSGHPKGYAYIEFATKGSVQAAVELDQSLFRGRVIKVLPKRTNFPGISSTDRGGLRGHPGSRGAPFPHSGLQGRPRLRPQGQNRARGKFSPWFSPY

SEQ ID NO: 64654 - protein, 266 aa, Homo sapiens
  Payload ID: 12891
  Gene Symbol: PABPN1L
  Gene Name: poly(A) binding protein, nuclear 1-like (cytoplasmic)
  ENSP ID: ENSP00000449247
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNLCLHRVCHQGLRAGRRGAGPEPLPGPGHQGAAEKNQLPWDQLHRPRGPSRTPRLQGGTLPPQRPPGQAPAQTTRAEPGPWKILTMVFTVLKGRPDFERGAGAWIRSKPLVLHP

SEQ ID NO: 64655 - protein, 745 aa, Homo sapiens
  Payload ID: 12892
  Gene Symbol: PAPOLA
  Gene Name: poly(A) polymerase alpha
  Uniprot ID: P51003
  ENSP ID: ENSP00000216277
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 64656 - protein, 724 aa, Homo sapiens
  Payload ID: 12892
  Gene Symbol: PAPOLA
  Gene Name: poly(A) polymerase alpha
  ENSP ID: ENSP00000376716
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEEQLDTETSTTQSETIQTAASLLASQKTSSTDLSDIPALPANPIPVIKNSIKLRLNR

SEQ ID NO: 64657 - protein, 285 aa, Homo sapiens
  Payload ID: 12892
  Gene Symbol: PAPOLA
  Gene Name: poly(A) polymerase alpha
  Uniprot ID: P51003
  ENSP ID: ENSP00000450437
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWYVFRLY

SEQ ID NO: 64658 - protein, 475 aa, Homo sapiens
  Payload ID: 12892
  Gene Symbol: PAPOLA
  Gene Name: poly(A) polymerase alpha
  ENSP ID: ENSP00000450534
MLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIP

SEQ ID NO: 64659 - protein, 203 aa, Homo sapiens
  Payload ID: 12892
  Gene Symbol: PAPOLA
  Gene Name: poly(A) polymerase alpha
  ENSP ID: ENSP00000450564
  MOD_RES (1)..(1): Any amino acid
XALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVSVLFFPLPIHTVQ

SEQ ID NO: 64660 - protein, 238 aa, Homo sapiens
  Payload ID: 12892
  Gene Symbol: PAPOLA
  Gene Name: poly(A) polymerase alpha
  ENSP ID: ENSP00000450812
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGMRKPTSFCVLQFLSDISCFYTSFVLKLFIAILLTQ

SEQ ID NO: 64661 - protein, 177 aa, Homo sapiens
  Payload ID: 12892
  Gene Symbol: PAPOLA
  Gene Name: poly(A) polymerase alpha
  ENSP ID: ENSP00000451267
MPFPVTTQGSQQTQPPQKHYGITSPISLAAPKETDCVLTQKLIETLKPFGVFEEEEELQRSNDLEYLIDNCFINRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDG

SEQ ID NO: 64662 - protein, 111 aa, Homo sapiens
  Payload ID: 12892
  Gene Symbol: PAPOLA
  Gene Name: poly(A) polymerase alpha
  ENSP ID: ENSP00000451600
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKD

SEQ ID NO: 64663 - protein, 181 aa, Homo sapiens
  Payload ID: 12892
  Gene Symbol: PAPOLA
  Gene Name: poly(A) polymerase alpha
  ENSP ID: ENSP00000451757
  MOD_RES (1)..(1): Any amino acid
XVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEKTSSTDLSDIPA

SEQ ID NO: 64664 - protein, 73 aa, Homo sapiens
  Payload ID: 12892
  Gene Symbol: PAPOLA
  Gene Name: poly(A) polymerase alpha
  ENSP ID: ENSP00000452578
  MOD_RES (1)..(1): Any amino acid
XNVAVVALGRHVRTKGKEEKRLKRRERCGRGVGPRAEAGPPLPPASVDHAQGGSGGGCGGEVTGRCRRRRRCR

SEQ ID NO: 64665 - protein, 637 aa, Homo sapiens
  Payload ID: 12893
  Gene Symbol: PAPOLB
  Gene Name: poly(A) polymerase beta (testis specific)
  Uniprot ID: Q9NRJ5
  ENSP ID: ENSP00000384700
MMPFPVTTQGPPQPAPPPNRYGVSSPISLAVPKETDCLLTQRLIETLRPFGVFEEEEELQRRILVLEKLNNLVKEWIREISESKSLPQSVIENVGGKIFTFGSYRLGVHTKGADIDALCVAPSHVDRSDFFTSFYAKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKCHNIYSNILGFLGGVSWAMLVARTCQLYPNAVASTLVRKFFLVFSEWEWPNPVLLKEPEERNLNLPVWDPRVNPSDRYHLMPIITPAYPQQNSTYNVSISTRMVMIEEFKQGLAITHEILLSKAEWSKLFEAPSFFQKYKHYIVLLASASTEKQHLEWVGLVESKIRILVGSLEKNEFITLAHVNPQSFPAPKENPDMEEFRTMWVIGLGLKKPDNSEILSIDLTYDIQSFTDTVYRQAVNSKMFEMGMKITAMHLRRKELHQLLPHHVLQDKKAHSTEGRRLTDLNDSSFDLSAGCENSMSVPSSTSTMKTGPLISSSQGRNSPALAVMTASVANIQATEFSLQQVNTNESSGVALNESIPHAVSQPAISPSPKAMVARVVSSTCLISHPDLQETQQQTYLIL

SEQ ID NO: 64666 - protein, 736 aa, Homo sapiens
  Payload ID: 12894
  Gene Symbol: PAPOLG
  Gene Name: poly(A) polymerase gamma
  Uniprot ID: Q9BWT3
  ENSP ID: ENSP00000238714
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 64667 - protein, 382 aa, Homo sapiens
  Payload ID: 12894
  Gene Symbol: PAPOLG
  Gene Name: poly(A) polymerase gamma
  ENSP ID: ENSP00000405570
RTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKDAIGGESMPIPTIDTSRKKRLPSKELPDSSSPVPANNIRVIKNSIRLTLNR

SEQ ID NO: 64668 - protein, 234 aa, Homo sapiens
  Payload ID: 12894
  Gene Symbol: PAPOLG
  Gene Name: poly(A) polymerase gamma
  ENSP ID: ENSP00000405599
MKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKW

SEQ ID NO: 64669 - protein, 168 aa, Homo sapiens
  Payload ID: 12894
  Gene Symbol: PAPOLG
  Gene Name: poly(A) polymerase gamma
  ENSP ID: ENSP00000414070
NTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEVVELLMKFCI

SEQ ID NO: 64670 - protein, 578 aa, Homo sapiens
  Payload ID: 12895
  Gene Symbol: PARN
  Gene Name: poly(A)-specific ribonuclease
  Uniprot ID: O95453
  ENSP ID: ENSP00000345456
MDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 64671 - protein, 639 aa, Homo sapiens
  Payload ID: 12895
  Gene Symbol: PARN
  Gene Name: poly(A)-specific ribonuclease
  Uniprot ID: O95453
  ENSP ID: ENSP00000387911
MEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 64672 - protein, 593 aa, Homo sapiens
  Payload ID: 12895
  Gene Symbol: PARN
  Gene Name: poly(A)-specific ribonuclease
  Uniprot ID: O95453
  ENSP ID: ENSP00000410525
MEIIRSNFKSNLHKVYQAIEEADFFAIDGEFSGISDGPSVSALTNGFDTPEERSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 64673 - protein, 464 aa, Homo sapiens
  Payload ID: 12895
  Gene Symbol: PARN
  Gene Name: poly(A)-specific ribonuclease
  Uniprot ID: O95453
  ENSP ID: ENSP00000444381
MEIIRSNFKSNLHKVYQAIEEADFFAIDGEFSGISDGPSVSALTNGFDTPEERYQKLKKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 64674 - protein, 207 aa, Homo sapiens
  Payload ID: 12895
  Gene Symbol: PARN
  Gene Name: poly(A)-specific ribonuclease
  ENSP ID: ENSP00000445659
MEIIRSNFKSNLHKVYQAIEEADFFAIDGEFSGISDGPSVSALTNGFDTPEERYQKLKKHSMDFLLFQFGLCTFKYDYTDSKSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKRSDI

SEQ ID NO: 64675 - protein, 261 aa, Homo sapiens
  Payload ID: 12895
  Gene Symbol: PARN
  Gene Name: poly(A)-specific ribonuclease
  ENSP ID: ENSP00000456279
  MOD_RES (1)..(1): Any amino acid
XANGAGALSYVSPNTSKCPVTIPEDQKKFIDQVVEKIEDLLQSEENKNLDLEPCTGFQRKLIYQTLSWKYPKGIHVETLETEKEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPD

SEQ ID NO: 64676 - protein, 109 aa, Homo sapiens
  Payload ID: 12895
  Gene Symbol: PARN
  Gene Name: poly(A)-specific ribonuclease
  ENSP ID: ENSP00000456982
MGSRCVFQADLEHMASRDPPASALQSAAITDFKSNLHKVYQAIEEADFFAIDGEFSGISDGPSVSALTNGFDTPEERYQKLKKHSMDFLLFQFGLCTFKYDYTDSKYIT

SEQ ID NO: 64677 - protein, 65 aa, Homo sapiens
  Payload ID: 12895
  Gene Symbol: PARN
  Gene Name: poly(A)-specific ribonuclease
  ENSP ID: ENSP00000458103
MEIIRSNFKSNLHKVYQAIEEADFFAIDGEFSGISDGPSVSALTNGFDTPEERYQKLKKVYNEVI

SEQ ID NO: 64678 - protein, 639 aa, Homo sapiens; identical to SEQ ID NO: 64671
  Payload ID: 12895
  Gene Symbol: PARN
  Gene Name: poly(A)-specific ribonuclease
  Uniprot ID: O95453
  ENSP ID: ENSP00000478668

SEQ ID NO: 64679 - protein, 593 aa, Homo sapiens; identical to SEQ ID NO: 64672
  Payload ID: 12895
  Gene Symbol: PARN
  Gene Name: poly(A)-specific ribonuclease
  Uniprot ID: O95453
  ENSP ID: ENSP00000484279

SEQ ID NO: 64680 - protein, 578 aa, Homo sapiens; identical to SEQ ID NO: 64670
  Payload ID: 12895
  Gene Symbol: PARN
  Gene Name: poly(A)-specific ribonuclease
  Uniprot ID: O95453
  ENSP ID: ENSP00000487634

SEQ ID NO: 64681 - protein, 207 aa, Homo sapiens; identical to SEQ ID NO: 64674
  Payload ID: 12895
  Gene Symbol: PARN
  Gene Name: poly(A)-specific ribonuclease
  ENSP ID: ENSP00000487870

SEQ ID NO: 64682 - protein, 261 aa, Homo sapiens; identical to SEQ ID NO: 64675
  Payload ID: 12895
  Gene Symbol: PARN
  Gene Name: poly(A)-specific ribonuclease
  ENSP ID: ENSP00000488415
  MOD_RES (1)..(1): Any amino acid

SEQ ID NO: 64683 - protein, 65 aa, Homo sapiens; identical to SEQ ID NO: 64677
  Payload ID: 12895
  Gene Symbol: PARN
  Gene Name: poly(A)-specific ribonuclease
  ENSP ID: ENSP00000488466

SEQ ID NO: 64684 - protein, 109 aa, Homo sapiens; identical to SEQ ID NO: 64676
  Payload ID: 12895
  Gene Symbol: PARN
  Gene Name: poly(A)-specific ribonuclease
  ENSP ID: ENSP00000488491

SEQ ID NO: 64685 - protein, 464 aa, Homo sapiens; identical to SEQ ID NO: 64673
  Payload ID: 12895
  Gene Symbol: PARN
  Gene Name: poly(A)-specific ribonuclease
  Uniprot ID: O95453
  ENSP ID: ENSP00000488554

SEQ ID NO: 64686 - protein, 39 aa, Homo sapiens
  Payload ID: 12896
  Gene Symbol: PNLDC1
  Gene Name: poly(A)-specific ribonuclease (PARN)-like domain containing 1
  ENSP ID: ENSP00000275275
MDVGADEFEESLPLLQELVQEADFVEVSAGALAACRSTV

SEQ ID NO: 64687 - protein, 531 aa, Homo sapiens
  Payload ID: 12896
  Gene Symbol: PNLDC1
  Gene Name: poly(A)-specific ribonuclease (PARN)-like domain containing 1
  Uniprot ID: Q8NA58
  ENSP ID: ENSP00000376007
MDVGADEFEESLPLLQELVQEADFVGLDIEFTGLRSNLSGPQQISLFDLPSEWYLKTRQSVQQFTVCQIGLSVFSAIEGEANKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGVVVKKVSKQHRWYLQNTSCDRESCWKENILLSARGFSVFFQMLVKAQKPLVGHNMMMDLLHLHEKFFRPLPESYDQFKQNIHSLFPVLIDTKSVTKDIWKEMNFPRVSNLSEVYEVLNSDLNPTKNSGPEIVHASRCEKYVETKCPHEAAYDAFLCGSVLLKVAHLLLQKIYHIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQVCGIVTAWALLAFILGRSGT

SEQ ID NO: 64688 - protein, 520 aa, Homo sapiens
  Payload ID: 12896
  Gene Symbol: PNLDC1
  Gene Name: poly(A)-specific ribonuclease (PARN)-like domain containing 1
  Uniprot ID: Q8NA58
  ENSP ID: ENSP00000476448
MFCTRGLLFFAFLAGLDIEFTGLRSNLSGPQQISLFDLPSEWYLKTRQSVQQFTVCQIGLSVFSAIEGEANKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGVVVKKVSKQHRWYLQNTSCDRESCWKENILLSARGFSVFFQMLVKAQKPLVGHNMMMDLLHLHEKFFRPLPESYDQFKQNIHSLFPVLIDTKSVTKDIWKEMNFPRVSNLSEVYEVLNSDLNPTKNSGPEIVHASRCEKYVETKCPHEAAYDAFLCGSVLLKVAHLLLQKIYHIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQVCGIVTAWALLAFILGRSGT

SEQ ID NO: 64689 - protein, 39 aa, Homo sapiens; identical to SEQ ID NO: 64686
  Payload ID: 12896
  Gene Symbol: PNLDC1
  Gene Name: poly(A)-specific ribonuclease (PARN)-like domain containing 1
  ENSP ID: ENSP00000476544

SEQ ID NO: 64690 - protein, 39 aa, Homo sapiens; identical to SEQ ID NO: 64686
  Payload ID: 12896
  Gene Symbol: PNLDC1
  Gene Name: poly(A)-specific ribonuclease (PARN)-like domain containing 1
  ENSP ID: ENSP00000476769

SEQ ID NO: 64691 - protein, 356 aa, Homo sapiens
  Payload ID: 12897
  Gene Symbol: PCBP1
  Gene Name: poly(rC) binding protein 1
  Uniprot ID: Q15365
  ENSP ID: ENSP00000305556
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 64692 - protein, 331 aa, Homo sapiens
  Payload ID: 12898
  Gene Symbol: PCBP2
  Gene Name: poly(rC) binding protein 2
  Uniprot ID: Q15366
  ENSP ID: ENSP00000352228
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64693 - protein, 366 aa, Homo sapiens
  Payload ID: 12898
  Gene Symbol: PCBP2
  Gene Name: poly(rC) binding protein 2
  Uniprot ID: Q15366
  ENSP ID: ENSP00000352438
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64694 - protein, 318 aa, Homo sapiens
  Payload ID: 12898
  Gene Symbol: PCBP2
  Gene Name: poly(rC) binding protein 2
  Uniprot ID: Q15366
  ENSP ID: ENSP00000388008
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64695 - protein, 318 aa, Homo sapiens; identical to SEQ ID NO: 64694
  Payload ID: 12898
  Gene Symbol: PCBP2
  Gene Name: poly(rC) binding protein 2
  Uniprot ID: Q15366
  ENSP ID: ENSP00000390304

SEQ ID NO: 64696 - protein, 335 aa, Homo sapiens
  Payload ID: 12898
  Gene Symbol: PCBP2
  Gene Name: poly(rC) binding protein 2
  Uniprot ID: Q15366
  ENSP ID: ENSP00000394116
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64697 - protein, 365 aa, Homo sapiens
  Payload ID: 12898
  Gene Symbol: PCBP2
  Gene Name: poly(rC) binding protein 2
  Uniprot ID: Q15366
  ENSP ID: ENSP00000408949
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 64698 - protein, 158 aa, Homo sapiens
  Payload ID: 12898
  Gene Symbol: PCBP2
  Gene Name: poly(rC) binding protein 2
  ENSP ID: ENSP00000446601
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIEC

SEQ ID NO: 64699 - protein, 202 aa, Homo sapiens
  Payload ID: 12898
  Gene Symbol: PCBP2
  Gene Name: poly(rC) binding protein 2
  ENSP ID: ENSP00000447068
GVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRERRVSLFCSGWSPTPELPMIRLPWSPKVLGLQIVQGLRSRWQGICYPTQLSGPSLLLAFHNPSLSVSNRSAWSCWSPPRRA

SEQ ID NO: 64700 - protein, 321 aa, Homo sapiens
  Payload ID: 12898
  Gene Symbol: PCBP2
  Gene Name: poly(rC) binding protein 2
  ENSP ID: ENSP00000447670
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64701 - protein, 64 aa, Homo sapiens
  Payload ID: 12898
  Gene Symbol: PCBP2
  Gene Name: poly(rC) binding protein 2
  ENSP ID: ENSP00000448079
MDTGVIEGGLNVTLTIRLLMHGKEVGSIIGKKGESVKKMREESGARINISEGNCPERIITLAGP

SEQ ID NO: 64702 - protein, 310 aa, Homo sapiens
  Payload ID: 12898
  Gene Symbol: PCBP2
  Gene Name: poly(rC) binding protein 2
  ENSP ID: ENSP00000448672
STGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVSLENAKPSSQAASVTIPDHLSINLSQPSTPSSSSSSTTTPSLATAGTSDAPSSLPNPLPTAPCVSSLLGMKPIPLLALNVVSAAKGTGASATTTTTSAVPCVTNKLKGEKQRFSPY

SEQ ID NO: 64703 - protein, 362 aa, Homo sapiens
  Payload ID: 12898
  Gene Symbol: PCBP2
  Gene Name: poly(rC) binding protein 2
  Uniprot ID: Q15366
  ENSP ID: ENSP00000448762
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64704 - protein, 160 aa, Homo sapiens
  Payload ID: 12898
  Gene Symbol: PCBP2
  Gene Name: poly(rC) binding protein 2
  ENSP ID: ENSP00000448847
MDTGVIEGGLNVTLTIRLLMHGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLE

SEQ ID NO: 64705 - protein, 361 aa, Homo sapiens
  Payload ID: 12898
  Gene Symbol: PCBP2
  Gene Name: poly(rC) binding protein 2
  Uniprot ID: Q15366
  ENSP ID: ENSP00000448927
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 64706 - protein, 335 aa, Homo sapiens; identical to SEQ ID NO: 64696
  Payload ID: 12898
  Gene Symbol: PCBP2
  Gene Name: poly(rC) binding protein 2
  Uniprot ID: Q15366
  ENSP ID: ENSP00000449062

SEQ ID NO: 64707 - protein, 322 aa, Homo sapiens
  Payload ID: 12898
  Gene Symbol: PCBP2
  Gene Name: poly(rC) binding protein 2
  Uniprot ID: Q15366
  ENSP ID: ENSP00000449070
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64708 - protein, 112 aa, Homo sapiens
  Payload ID: 12898
  Gene Symbol: PCBP2
  Gene Name: poly(rC) binding protein 2
  ENSP ID: ENSP00000454797
  MOD_RES (1)..(1): Any amino acid
XAGPTNAIFKAFAMIIDKLEEDISSSMTNSTAASRPPVTLRLVVPASQCGSLIGKGGCKIKEIREAGVQWRSHGSLQQNIDLPSLRRSSHLSLPRSRDCRLPPPHPNFCIFL

SEQ ID NO: 64709 - protein, 301 aa, Homo sapiens
  Payload ID: 12898
  Gene Symbol: PCBP2
  Gene Name: poly(rC) binding protein 2
  ENSP ID: ENSP00000456412
  MOD_RES (1)..(1): Any amino acid
XHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 64710 - protein, 36 aa, Homo sapiens
  Payload ID: 12898
  Gene Symbol: PCBP2
  Gene Name: poly(rC) binding protein 2
  ENSP ID: ENSP00000456795
MDTGVIEGGLNVTLTIRLLMHGKEVGSIIGKKGESV

SEQ ID NO: 64711 - protein, 184 aa, Homo sapiens
  Payload ID: 12898
  Gene Symbol: PCBP2
  Gene Name: poly(rC) binding protein 2
  ENSP ID: ENSP00000456842
  MOD_RES (1)..(1): Any amino acid
XLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 64712 - protein, 361 aa, Homo sapiens
  Payload ID: 12899
  Gene Symbol: PCBP3
  Gene Name: poly(rC) binding protein 3
  ENSP ID: ENSP00000383159
MESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQVRADPLAASTANLSLLLQHPPLPAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 64713 - protein, 322 aa, Homo sapiens
  Payload ID: 12899
  Gene Symbol: PCBP3
  Gene Name: poly(rC) binding protein 3
  ENSP ID: ENSP00000383160
PQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 64714 - protein, 345 aa, Homo sapiens
  Payload ID: 12899
  Gene Symbol: PCBP3
  Gene Name: poly(rC) binding protein 3
  Uniprot ID: P57721
  ENSP ID: ENSP00000383163
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 64715 - protein, 370 aa, Homo sapiens
  Payload ID: 12899
  Gene Symbol: PCBP3
  Gene Name: poly(rC) binding protein 3
  Uniprot ID: P57721
  ENSP ID: ENSP00000383164
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 64716 - protein, 351 aa, Homo sapiens
  Payload ID: 12899
  Gene Symbol: PCBP3
  Gene Name: poly(rC) binding protein 3
  Uniprot ID: P57721
  ENSP ID: ENSP00000383165
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGLDASPPASTHELTIPNDLIGCIIGRQGTKINEIRQMSGAQIKIANATEGSSERQITITGTPANISLAQYLINARLTSEVTGMGTL

SEQ ID NO: 64717 - protein, 371 aa, Homo sapiens
  Payload ID: 12899
  Gene Symbol: PCBP3
  Gene Name: poly(rC) binding protein 3
  Uniprot ID: P57721
  ENSP ID: ENSP00000383168
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 64718 - protein, 361 aa, Homo sapiens; identical to SEQ ID NO: 64712
  Payload ID: 12899
  Gene Symbol: PCBP3
  Gene Name: poly(rC) binding protein 3
  ENSP ID: ENSP00000401198

SEQ ID NO: 64719 - protein, 5 aa, Homo sapiens
  Payload ID: 12899
  Gene Symbol: PCBP3
  Gene Name: poly(rC) binding protein 3
  ENSP ID: ENSP00000448986
MESKV

SEQ ID NO: 64720 - protein, 403 aa, Homo sapiens
  Payload ID: 12900
  Gene Symbol: PCBP4
  Gene Name: poly(rC) binding protein 4
  Uniprot ID: P57723
  ENSP ID: ENSP00000322341
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 64721 - protein, 403 aa, Homo sapiens; identical to SEQ ID NO: 64720
  Payload ID: 12900
  Gene Symbol: PCBP4
  Gene Name: poly(rC) binding protein 4
  Uniprot ID: P57723
  ENSP ID: ENSP00000348111

SEQ ID NO: 64722 - protein, 378 aa, Homo sapiens
  Payload ID: 12900
  Gene Symbol: PCBP4
  Gene Name: poly(rC) binding protein 4
  ENSP ID: ENSP00000378461
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPQLPLACWAHPMPSPSPTSSAQAHALLGFTTCFPRAAAGL

SEQ ID NO: 64723 - protein, 360 aa, Homo sapiens
  Payload ID: 12900
  Gene Symbol: PCBP4
  Gene Name: poly(rC) binding protein 4
  Uniprot ID: P57723
  ENSP ID: ENSP00000395030
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 64724 - protein, 360 aa, Homo sapiens; identical to SEQ ID NO: 64723
  Payload ID: 12900
  Gene Symbol: PCBP4
  Gene Name: poly(rC) binding protein 4
  Uniprot ID: P57723
  ENSP ID: ENSP00000417100

SEQ ID NO: 64725 - protein, 403 aa, Homo sapiens; identical to SEQ ID NO: 64720
  Payload ID: 12900
  Gene Symbol: PCBP4
  Gene Name: poly(rC) binding protein 4
  Uniprot ID: P57723
  ENSP ID: ENSP00000417196

SEQ ID NO: 64726 - protein, 106 aa, Homo sapiens
  Payload ID: 12900
  Gene Symbol: PCBP4
  Gene Name: poly(rC) binding protein 4
  ENSP ID: ENSP00000417916
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRL

SEQ ID NO: 64727 - protein, 86 aa, Homo sapiens
  Payload ID: 12900
  Gene Symbol: PCBP4
  Gene Name: poly(rC) binding protein 4
  ENSP ID: ENSP00000418312
MSGSDGGLEEEPELSITLTLRMLMHGKEVGSIIGKKGETVKRIREQSSARITISEGSCPERITTITGSTAAVFHAVSMIAFKLDEV

SEQ ID NO: 64728 - protein, 57 aa, Homo sapiens
  Payload ID: 12900
  Gene Symbol: PCBP4
  Gene Name: poly(rC) binding protein 4
  ENSP ID: ENSP00000418613
MSGSDGGLEEEPELSITLTLRMLMHGKEVGSIIGKKGETVKRIREQCPDHHLRGLLP

SEQ ID NO: 64729 - protein, 323 aa, Homo sapiens
  Payload ID: 12900
  Gene Symbol: PCBP4
  Gene Name: poly(rC) binding protein 4
  ENSP ID: ENSP00000418925
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITAWAAAGLGGLHCQDGSS

SEQ ID NO: 64730 - protein, 74 aa, Homo sapiens
  Payload ID: 12900
  Gene Symbol: PCBP4
  Gene Name: poly(rC) binding protein 4
  ENSP ID: ENSP00000418997
MSGSDGGLEEEPELSITLTLRMLMHGKEVGSIIGKKGETVKRIREQSSARITISEGSCPERITTITGSTAAVFH

SEQ ID NO: 64731 - protein, 124 aa, Homo sapiens
  Payload ID: 12900
  Gene Symbol: PCBP4
  Gene Name: poly(rC) binding protein 4
  ENSP ID: ENSP00000419557
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKI

SEQ ID NO: 64732 - protein, 46 aa, Homo sapiens
  Payload ID: 12900
  Gene Symbol: PCBP4
  Gene Name: poly(rC) binding protein 4
  ENSP ID: ENSP00000419672
MSGSDGGLEEEPELSITLTLRMLMHGKEVGSIIGKKGETVKRIREQ

SEQ ID NO: 64733 - protein, 168 aa, Homo sapiens
  Payload ID: 12900
  Gene Symbol: PCBP4
  Gene Name: poly(rC) binding protein 4
  ENSP ID: ENSP00000419694
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICA

SEQ ID NO: 64734 - protein, 91 aa, Homo sapiens
  Payload ID: 12900
  Gene Symbol: PCBP4
  Gene Name: poly(rC) binding protein 4
  ENSP ID: ENSP00000420008
MSGSDGGLEEEPELSITLTLRMLMHGKEVGSIIGKKGETVKRIREQSSARITISEGSCPERITTITGSTAAVFHAVSMIAFKLDEDLCAAP

SEQ ID NO: 64735 - protein, 1007 aa, Homo sapiens
  Payload ID: 12901
  Gene Symbol: PMFBP1
  Gene Name: polyamine modulated factor 1 binding protein 1
  Uniprot ID: Q8TBY8
  ENSP ID: ENSP00000237353
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 64736 - protein, 882 aa, Homo sapiens
  Payload ID: 12901
  Gene Symbol: PMFBP1
  Gene Name: polyamine modulated factor 1 binding protein 1
  Uniprot ID: Q8TBY8
  ENSP ID: ENSP00000347854
MGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDREPTRASSPNTTRPSSPSHSHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 64737 - protein, 101 aa, Homo sapiens
  Payload ID: 12901
  Gene Symbol: PMFBP1
  Gene Name: polyamine modulated factor 1 binding protein 1
  ENSP ID: ENSP00000368364
MKDEAGERDREVSSLNSKLLSLQLDIKNLHDVCKRQRKTLQDNQLCMEEAMNSSHLIALKISDHSDTRGAASAMDLRQTSKSTMKIKTITPALRTRSKHRH

SEQ ID NO: 64738 - protein, 502 aa, Homo sapiens
  Payload ID: 12901
  Gene Symbol: PMFBP1
  Gene Name: polyamine modulated factor 1 binding protein 1
  ENSP ID: ENSP00000439564
QVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEKCS

SEQ ID NO: 64739 - protein, 68 aa, Homo sapiens
  Payload ID: 12901
  Gene Symbol: PMFBP1
  Gene Name: polyamine modulated factor 1 binding protein 1
  ENSP ID: ENSP00000439841
MKDEAGERDREVSSLNSKLLSLQLDIKNLHDVCKRQRKTLQDNQLCMEEAMNSSHDKKQAQALAFEES

SEQ ID NO: 64740 - protein, 47 aa, Homo sapiens
  Payload ID: 12901
  Gene Symbol: PMFBP1
  Gene Name: polyamine modulated factor 1 binding protein 1
  ENSP ID: ENSP00000440755
MKDEAGERDREVSSLNSKLLSLQLDIKNLHDVCKRQRKTLQDNQLCM

SEQ ID NO: 64741 - protein, 110 aa, Homo sapiens
  Payload ID: 12901
  Gene Symbol: PMFBP1
  Gene Name: polyamine modulated factor 1 binding protein 1
  ENSP ID: ENSP00000440941
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYS

SEQ ID NO: 64742 - protein, 116 aa, Homo sapiens
  Payload ID: 12901
  Gene Symbol: PMFBP1
  Gene Name: polyamine modulated factor 1 binding protein 1
  ENSP ID: ENSP00000443366
MLAAKEEQLREFQEEMAALKENLLEDDKEPCCLPQWSVPKDTCRLYRGNDQIMTNLEQWAKQQKVANEKLGNQLREQVKYIAKLSGEKESFLLLYTRIKKDSHSQVTHTPSVLGQF

SEQ ID NO: 64743 - protein, 1022 aa, Homo sapiens
  Payload ID: 12901
  Gene Symbol: PMFBP1
  Gene Name: polyamine modulated factor 1 binding protein 1
  ENSP ID: ENSP00000443817
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAGEAPAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVKYIAKLSGEKDHLHSVMVHLQQENKKLKKEIEEKKMKAENTRLCTKALGPSRTESTQREKVCGTLGWKGLPQDMGQRMDLTKYIGMPHCPGTSAICQKNKCDFFL

SEQ ID NO: 64744 - protein, 156 aa, Homo sapiens
  Payload ID: 12901
  Gene Symbol: PMFBP1
  Gene Name: polyamine modulated factor 1 binding protein 1
  ENSP ID: ENSP00000444953
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEK

SEQ ID NO: 64745 - protein, 511 aa, Homo sapiens [sequence omitted]

SEQ ID NO: 64746 - protein, 325 aa, Homo sapiens
  Payload ID: 12902
  Gene Symbol: PAOX
  Gene Name: polyamine oxidase (exo-N4-amino)
  Uniprot ID: Q6QHF9
  ENSP ID: ENSP00000348654
MESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGLSTFSVGSLPDLSLSSWRLCRMKKYFCVSPKCSGE

SEQ ID NO: 64747 - protein, 486 aa, Homo sapiens
  Payload ID: 12902
  Gene Symbol: PAOX
  Gene Name: polyamine oxidase (exo-N4-amino)
  Uniprot ID: Q6QHF9
  ENSP ID: ENSP00000349847
MESTGSVGEAPGGPRVLVVGGGIAGLGAAQRLCGHSAFPHLRVLEATARAGGRIRSERCFGGVVEVGAHWIHGPSRGNPVFQLAAEYGLLGEKELSQENQLVETGGHVGLPSVSYASSGASVSLQLVAEMATLFYGLIDQTREFLHAAETPVPSVGEYLKKEIGQHVAGWTEDEETRKLKLAVLNSFFNLECCVSGTHSMDLVALAPFGEYTVLPGLDCTFSKGYQGLTNCMMAALPEDTVVFEKPVKTIHWNGSFQEAAFPGETFPVSVECEDGDRFPAHHVIVTVPLGFLREHLDTFFDPPLPAEKAEAIRKIGFGTNNKIFLEFEEPFWEPDCQLIQLVWEDTSPLEDAAPELQDAWFRKLIGFVVLPAFASVHVLCGFIAGLESEFMETLSDEEVLLCLTQVLRRVTAPDPVCGGSHTSHVLLHDARGSAVGMEGGRPPPQSVGPAGAAAQAQALAGPSLLCSTRVGGRLGPSFLLTDFSLA

SEQ ID NO: 64748 - protein, 112 aa, Homo sapiens
  Payload ID: 12902
  Gene Symbol: PAOX
  Gene Name: polyamine oxidase (exo-N4-amino)
  ENSP ID: ENSP00000357527
MATLFYGLIDQTREFLHAAETPVPSVGEYLKKEIGQHVAGWTEDEETRKLKLAVLNSFFNLECCVSGTHSTGLCCRDGGRPTASSVCGPRRCSSPGPGSSWAQPTLFHPCRG

SEQ ID NO: 64749 - protein, 69 aa, Homo sapiens
  Payload ID: 12902
  Gene Symbol: PAOX
  Gene Name: polyamine oxidase (exo-N4-amino)
  Uniprot ID: Q6QHF9
  ENSP ID: ENSP00000432517
MESTGSVGEAPGGPRVLVVGGGIAGLGAAQRLCGHSAFPHLRVLEATARAGGRIRSERCFGAIKDSQTA

SEQ ID NO: 64750 - protein, 69 aa, Homo sapiens; identical to SEQ ID NO: 64749
  Payload ID: 12902
  Gene Symbol: PAOX
  Gene Name: polyamine oxidase (exo-N4-amino)
  Uniprot ID: Q6QHF9
  ENSP ID: ENSP00000432737

SEQ ID NO: 64751 - protein, 69 aa, Homo sapiens; identical to SEQ ID NO: 64749
  Payload ID: 12902
  Gene Symbol: PAOX
  Gene Name: polyamine oxidase (exo-N4-amino)
  Uniprot ID: Q6QHF9
  ENSP ID: ENSP00000434550

SEQ ID NO: 64752 - protein, 325 aa, Homo sapiens; identical to SEQ ID NO: 64746
  Payload ID: 12902
  Gene Symbol: PAOX
  Gene Name: polyamine oxidase (exo-N4-amino)
  Uniprot ID: Q6QHF9
  ENSP ID: ENSP00000435514

SEQ ID NO: 64753 - protein, 207 aa, Homo sapiens
  Payload ID: 12903
  Gene Symbol: PMF1
  Gene Name: polyamine-modulated factor 1
  Uniprot ID: Q6P1K2
  ENSP ID: ENSP00000357256
MAEASSANLGSGCEEKRHEGSSSESVPPGTTISRVKLLDTMVDTFLQKLVAAGSSPLLHWDGSAGPRLPSGGQSVKQAFSWAACRLPQGRKEEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 64754 - protein, 205 aa, Homo sapiens
  Payload ID: 12903
  Gene Symbol: PMF1
  Gene Name: polyamine-modulated factor 1
  Uniprot ID: Q6P1K2
  ENSP ID: ENSP00000357260
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 64755 - protein, 180 aa, Homo sapiens
  Payload ID: 12903
  Gene Symbol: PMF1
  Gene Name: polyamine-modulated factor 1
  Uniprot ID: Q6P1K2
  ENSP ID: ENSP00000357262
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRLYTENRGSWLLC

SEQ ID NO: 64756 - protein, 93 aa, Homo sapiens
  Payload ID: 12903
  Gene Symbol: PMF1
  Gene Name: polyamine-modulated factor 1
  ENSP ID: ENSP00000476760
  MOD_RES (1)..(1): Any amino acid
XSSANLGSGCEEKRHEGSSSESVPPGTTISRVKLLDTMVDTFLQKLVAAGSSPLLHWDGSAGPRLPSGGQSVKQAFSWAACRLPQGRKLPEIH

SEQ ID NO: 64757 - protein, 87 aa, Homo sapiens
  Payload ID: 12903
  Gene Symbol: PMF1
  Gene Name: polyamine-modulated factor 1
  ENSP ID: ENSP00000476770
MAEASSANLGSGCEEKRHEGSSSESVPPGTTISRVKLLDTMVDTFLQKLVAAGRRSFTLVAQTGVQWRDLGSWQPPPPGFKQFSSAS

SEQ ID NO: 64758 - protein, 1689 aa, Homo sapiens
  Payload ID: 12904
  Gene Symbol: PBRM1
  Gene Name: polybromo 1
  Uniprot ID: Q86U86
  ENSP ID: ENSP00000296302
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64759 - protein, 1582 aa, Homo sapiens
  Payload ID: 12904
  Gene Symbol: PBRM1
  Gene Name: polybromo 1
  Uniprot ID: Q86U86
  ENSP ID: ENSP00000338302
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64760 - protein, 1602 aa, Homo sapiens
  Payload ID: 12904
  Gene Symbol: PBRM1
  Gene Name: polybromo 1
  Uniprot ID: Q86U86
  ENSP ID: ENSP00000349213
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMSNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64761 - protein, 1582 aa, Homo sapiens
  Payload ID: 12904
  Gene Symbol: PBRM1
  Gene Name: polybromo 1
  Uniprot ID: Q86U86
  ENSP ID: ENSP00000378307
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64762 - protein, 1609 aa, Homo sapiens
  Payload ID: 12904
  Gene Symbol: PBRM1
  Gene Name: polybromo 1
  Uniprot ID: Q86U86
  ENSP ID: ENSP00000386529
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64763 - protein, 1634 aa, Homo sapiens
  Payload ID: 12904
  Gene Symbol: PBRM1
  Gene Name: polybromo 1
  Uniprot ID: Q86U86
  ENSP ID: ENSP00000386593
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64764 - protein, 1597 aa, Homo sapiens
  Payload ID: 12904
  Gene Symbol: PBRM1
  Gene Name: polybromo 1
  Uniprot ID: Q86U86
  ENSP ID: ENSP00000386601
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64765 - protein, 1652 aa, Homo sapiens
  Payload ID: 12904
  Gene Symbol: PBRM1
  Gene Name: polybromo 1
  Uniprot ID: Q86U86
  ENSP ID: ENSP00000386643
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 64766 - protein, 1460 aa, Homo sapiens
  Payload ID: 12904
  Gene Symbol: PBRM1
  Gene Name: polybromo 1
  ENSP ID: ENSP00000387775
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKRAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPG

SEQ ID NO: 64767 - protein, 152 aa, Homo sapiens
  Payload ID: 12904
  Gene Symbol: PBRM1
  Gene Name: polybromo 1
  ENSP ID: ENSP00000389390
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFV

SEQ ID NO: 64768 - protein, 26 aa, Homo sapiens
  Payload ID: 12904
  Gene Symbol: PBRM1
  Gene Name: polybromo 1
  ENSP ID: ENSP00000397399
MGSKRRRATSPSSSVSGDFDDGHHSV

SEQ ID NO: 64769 - protein, 1085 aa, Homo sapiens
  Payload ID: 12904
  Gene Symbol: PBRM1
  Gene Name: polybromo 1
  ENSP ID: ENSP00000397662
IRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKRAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNL

SEQ ID NO: 64770 - protein, 856 aa, Homo sapiens
  Payload ID: 12904
  Gene Symbol: PBRM1
  Gene Name: polybromo 1
  Uniprot ID: Q86U86
  ENSP ID: ENSP00000404579
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNR

SEQ ID NO: 64771 - protein, 43 aa, Homo sapiens
  Payload ID: 12904
  Gene Symbol: PBRM1
  Gene Name: polybromo 1
  ENSP ID: ENSP00000404635
MGSKRRRATSPSSSVSGDFDDGHHSVSTPGPSRKRRRLSNLPT

SEQ ID NO: 64772 - protein, 230 aa, Homo sapiens
  Payload ID: 12904
  Gene Symbol: PBRM1
  Gene Name: polybromo 1
  ENSP ID: ENSP00000409939
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDL

SEQ ID NO: 64773 - protein, 43 aa, Homo sapiens; identical to SEQ ID NO: 64771
  Payload ID: 12904
  Gene Symbol: PBRM1
  Gene Name: polybromo 1
  ENSP ID: ENSP00000411895

SEQ ID NO: 64774 - protein, 118 aa, Homo sapiens
  Payload ID: 12904
  Gene Symbol: PBRM1
  Gene Name: polybromo 1
  ENSP ID: ENSP00000412401
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQL

SEQ ID NO: 64775 - protein, 87 aa, Homo sapiens
  Payload ID: 12904
  Gene Symbol: PBRM1
  Gene Name: polybromo 1
  ENSP ID: ENSP00000416851
MGSKRRRATSPSSSVSGDFDDGHHSVSTPGPSRKRRRLSNLPTVDPIAVCHELYNTIRDYKDEQGRLLCELFIRAPKRRNQPDYYEV

SEQ ID NO: 64776 - protein, 259 aa, Homo sapiens
  Payload ID: 12905
  Gene Symbol: PCGF1
  Gene Name: polycomb group ring finger 1
  Uniprot ID: Q9BSM1
  ENSP ID: ENSP00000233630
MASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 64777 - protein, 237 aa, Homo sapiens
  Payload ID: 12905
  Gene Symbol: PCGF1
  Gene Name: polycomb group ring finger 1
  ENSP ID: ENSP00000478746
MIGDGGCIFEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 64778 - protein, 344 aa, Homo sapiens
  Payload ID: 12906
  Gene Symbol: PCGF2
  Gene Name: polycomb group ring finger 2
  ENSP ID: ENSP00000478517
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 64779 - protein, 344 aa, Homo sapiens; identical to SEQ ID NO: 64778
  Payload ID: 12906
  Gene Symbol: PCGF2
  Gene Name: polycomb group ring finger 2
  Uniprot ID: P35227
  ENSP ID: ENSP00000478970

SEQ ID NO: 64780 - protein, 257 aa, Homo sapiens
  Payload ID: 12906
  Gene Symbol: PCGF2
  Gene Name: polycomb group ring finger 2
  ENSP ID: ENSP00000481656
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARQGPGREEGPPGEWGWGQRENRGALPAMPSSHDRHASCQVSPQQDGCAQQVQGGGSVRGRATEGILHPHGHRLHLPLAAERASPPQVPCPASLQAAHPSHGAHPLRGHQHQRGVRV

SEQ ID NO: 64781 - protein, 344 aa, Homo sapiens; identical to SEQ ID NO: 64778
  Payload ID: 12906
  Gene Symbol: PCGF2
  Gene Name: polycomb group ring finger 2
  Uniprot ID: P35227
  ENSP ID: ENSP00000482063

SEQ ID NO: 64782 - protein, 344 aa, Homo sapiens; identical to SEQ ID NO: 64778
  Payload ID: 12906
  Gene Symbol: PCGF2
  Gene Name: polycomb group ring finger 2
  Uniprot ID: P35227
  ENSP ID: ENSP00000482815

SEQ ID NO: 64783 - protein, 66 aa, Homo sapiens
  Payload ID: 12906
  Gene Symbol: PCGF2
  Gene Name: polycomb group ring finger 2
  ENSP ID: ENSP00000483741
  MOD_RES (1)..(1): Any amino acid
XPLPLKYRVQPACKRLTLATVPTPSEGTNTSGASESEARSPGQDRATASKSTRRQKPVSSDPTPTP

SEQ ID NO: 64784 - protein, 257 aa, Homo sapiens; identical to SEQ ID NO: 64780
  Payload ID: 12906
  Gene Symbol: PCGF2
  Gene Name: polycomb group ring finger 2
  ENSP ID: ENSP00000484201

SEQ ID NO: 64785 - protein, 203 aa, Homo sapiens
  Payload ID: 12906
  Gene Symbol: PCGF2
  Gene Name: polycomb group ring finger 2
  ENSP ID: ENSP00000484721
MCDVQVHKTRPLLSIRSDKTLQDIVYKLVPGLFKDEMKRRRDFYAAYPLTEVPNGSNEDRGEVLEQEKGALSDDEIVSLSIEFYEGARQGPGREEGPPGEWGWGQRENRGALPAMPSSHDRHASCQVSPQQDGCAQQVQGGGSVRGRATEGILHPHGHRLHLPLAAERASPPQVPCPASLQAAHPSHGAHPLRGHQHQRGVRV

SEQ ID NO: 64786 - protein, 66 aa, Homo sapiens; identical to SEQ ID NO: 64783
  Payload ID: 12906
  Gene Symbol: PCGF2
  Gene Name: polycomb group ring finger 2
  ENSP ID: ENSP00000487834
  MOD_RES (1)..(1): Any amino acid

SEQ ID NO: 64787 - protein, 203 aa, Homo sapiens; identical to SEQ ID NO: 64785
  Payload ID: 12906
  Gene Symbol: PCGF2
  Gene Name: polycomb group ring finger 2
  ENSP ID: ENSP00000487887

SEQ ID NO: 64788 - protein, 257 aa, Homo sapiens; identical to SEQ ID NO: 64780
  Payload ID: 12906
  Gene Symbol: PCGF2
  Gene Name: polycomb group ring finger 2
  ENSP ID: ENSP00000487914

SEQ ID NO: 64789 - protein, 257 aa, Homo sapiens; identical to SEQ ID NO: 64780
  Payload ID: 12906
  Gene Symbol: PCGF2
  Gene Name: polycomb group ring finger 2
  ENSP ID: ENSP00000487929

SEQ ID NO: 64790 - protein, 344 aa, Homo sapiens; identical to SEQ ID NO: 64778
  Payload ID: 12906
  Gene Symbol: PCGF2
  Gene Name: polycomb group ring finger 2
  ENSP ID: ENSP00000488868

SEQ ID NO: 64791 - protein, 344 aa, Homo sapiens; identical to SEQ ID NO: 64778
  Payload ID: 12906
  Gene Symbol: PCGF2
  Gene Name: polycomb group ring finger 2
  ENSP ID: ENSP00000488872

SEQ ID NO: 64792 - protein, 242 aa, Homo sapiens
  Payload ID: 12907
  Gene Symbol: PCGF3
  Gene Name: polycomb group ring finger 3
  Uniprot ID: Q3KNV8
  ENSP ID: ENSP00000354724
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 64793 - protein, 173 aa, Homo sapiens
  Payload ID: 12907
  Gene Symbol: PCGF3
  Gene Name: polycomb group ring finger 3
  ENSP ID: ENSP00000383015
MLTRKIKLWDINAHITCRLCSGYLIDATTVTECLHTCTCPARATQGGRALPSSVLFRTLAFVLPHAFSSSPTKAGTRTRGRDDLEDKSEKSFHAKGPVGGVRADEASLRRAKHRRDPTFLPRSSKASSRCDSAHCWQFPNLQRSSLDPSKGNLPVCSSHLMCVLTPDESVLWC

SEQ ID NO: 64794 - protein, 109 aa, Homo sapiens
  Payload ID: 12907
  Gene Symbol: PCGF3
  Gene Name: polycomb group ring finger 3
  ENSP ID: ENSP00000398493
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIK

SEQ ID NO: 64795 - protein, 62 aa, Homo sapiens
  Payload ID: 12907
  Gene Symbol: PCGF3
  Gene Name: polycomb group ring finger 3
  ENSP ID: ENSP00000401431
MLTRKIKLWDINAHITCRLCSGYLIDATTVTECLHTFCRSCLVKYLEENNTCPTCRIVIHQS

SEQ ID NO: 64796 - protein, 114 aa, Homo sapiens
  Payload ID: 12907
  Gene Symbol: PCGF3
  Gene Name: polycomb group ring finger 3
  ENSP ID: ENSP00000402946
MLTRKIKLWDINAHITCRLCSGYLIDATTVTECLHTSQARQKQEPGPGAETILKISQKSHFTLKVLWVVSEQMRPRLGERNTGETPHSSHGAARPVAAVTVLTAGSFQISRGVP

SEQ ID NO: 64797 - protein, 114 aa, Homo sapiens; identical to SEQ ID NO: 64796
  Payload ID: 12907
  Gene Symbol: PCGF3
  Gene Name: polycomb group ring finger 3
  ENSP ID: ENSP00000405840

SEQ ID NO: 64798 - protein, 40 aa, Homo sapiens
  Payload ID: 12907
  Gene Symbol: PCGF3
  Gene Name: polycomb group ring finger 3
  ENSP ID: ENSP00000416279
MLTRKIKLWDINAHITCRLCSGYLIDATTVTECLHTFCRS

SEQ ID NO: 64799 - protein, 242 aa, Homo sapiens; identical to SEQ ID NO: 64792
  Payload ID: 12907
  Gene Symbol: PCGF3
  Gene Name: polycomb group ring finger 3
  Uniprot ID: Q3KNV8
  ENSP ID: ENSP00000420489

SEQ ID NO: 64800 - protein, 242 aa, Homo sapiens; identical to SEQ ID NO: 64792
  Payload ID: 12907
  Gene Symbol: PCGF3
  Gene Name: polycomb group ring finger 3
  Uniprot ID: Q3KNV8
  ENSP ID: ENSP00000423393

SEQ ID NO: 64801 - protein, 132 aa, Homo sapiens
  Payload ID: 12907
  Gene Symbol: PCGF3
  Gene Name: polycomb group ring finger 3
  ENSP ID: ENSP00000479441
MEFQNMYIQLFGFSFFIVIIVRMLLLGLCVSARQPVMPRATLWGHLSPAWVLVPWTPRACGQAAPGQGHVASDHKSGAALAQALQLPAPPGFAALLVFSEQQQNSVHSDSKGGIGLDVLGTSQPSPTLYVNV

SEQ ID NO: 64802 - protein, 256 aa, Homo sapiens
  Payload ID: 12908
  Gene Symbol: PCGF5
  Gene Name: polycomb group ring finger 5
  Uniprot ID: Q86SE9
  ENSP ID: ENSP00000337500
MATQRKHLVKDFNPYITCYICKGYLIKPTTVTECLHTFCKTCIVQHFEDSNDCPRCGNQVHETNPLEMLRLDNTLEEIIFKLVPGLREQELERESEFWKKNKPQENGQDDTSKADKPKVDEEGDENEDDKDYHRSDPQIAICLDCLRNNGQSGDNVVKGLMKKFIRCSTRVTVGTIKKFLSLKLKLPSSYELDVLCNGEIMGKDHTMEFIYMTRWRLRGENFRCLNCSASQVCSQDGPLYQSYPMVLQYRPRIDFG

SEQ ID NO: 64803 - protein, 256 aa, Homo sapiens; identical to SEQ ID NO: 64802
  Payload ID: 12908
  Gene Symbol: PCGF5
  Gene Name: polycomb group ring finger 5
  Uniprot ID: Q86SE9
  ENSP ID: ENSP00000445704

SEQ ID NO: 64804 - protein, 256 aa, Homo sapiens; identical to SEQ ID NO: 64802
  Payload ID: 12908
  Gene Symbol: PCGF5
  Gene Name: polycomb group ring finger 5
  Uniprot ID: Q86SE9
  ENSP ID: ENSP00000479492

SEQ ID NO: 64805 - protein, 275 aa, Homo sapiens
  Payload ID: 12909
  Gene Symbol: PCGF6
  Gene Name: polycomb group ring finger 6
  Uniprot ID: Q9BYE7
  ENSP ID: ENSP00000338845
MEGVAVVTAGSVGAAKTEGAAALPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNISANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 64806 - protein, 350 aa, Homo sapiens
  Payload ID: 12909
  Gene Symbol: PCGF6
  Gene Name: polycomb group ring finger 6
  Uniprot ID: Q9BYE7
  ENSP ID: ENSP00000358862
MEGVAVVTAGSVGAAKTEGAAALPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEREKKQMHDFYKERGLEVPKPAVPQPVPSSKGRSKKVLESVFRIPPELDMSLLLEFIGANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 64807 - protein, 3396 aa, Homo sapiens
  Payload ID: 12910
  Gene Symbol: PKHD1
  Gene Name: polycystic kidney and hepatic disease 1 (autosomal recessive)
  Uniprot ID: P08F94
  ENSP ID: ENSP00000341097
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAVTTEQALKISE

SEQ ID NO: 64808 - protein, 4074 aa, Homo sapiens
  Payload ID: 12910
  Gene Symbol: PKHD1
  Gene Name: polycystic kidney and hepatic disease 1 (autosomal recessive)
  Uniprot ID: P08F94
  ENSP ID: ENSP00000360158
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKSTIILAASLSSVASWLALSCLVCCWLKRSKSRKTKPEEIPESQTNNQNIHIHISSKRRESQGPKKEDTVVGEDMRMKVMLGKVNQCPHQLMNGVSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSQEKKASCGATEAFCLHSVHPETIQEQL

SEQ ID NO: 64809 - protein, 4243 aa, Homo sapiens
  Payload ID: 12911
  Gene Symbol: PKHD1L1
  Gene Name: polycystic kidney and hepatic disease 1 (autosomal recessive)-like 1
  Uniprot ID: Q86WI1
  ENSP ID: ENSP00000367655
MGHLWLLGIWGLCGLLLCAADPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVVQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 64810 - protein, 1171 aa, Homo sapiens
  Payload ID: 12911
  Gene Symbol: PKHD1L1
  Gene Name: polycystic kidney and hepatic disease 1 (autosomal recessive)-like 1
  ENSP ID: ENSP00000437376
KQEKINQNVTVIRNNPHIPCKPQMVLNLYQLNQLDCPGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 64811 - protein, 4303 aa, Homo sapiens
  Payload ID: 12912
  Gene Symbol: PKD1
  Gene Name: polycystic kidney disease 1 (autosomal dominant)
  Uniprot ID: P98161
  ENSP ID: ENSP00000262304
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 64812 - protein, 4302 aa, Homo sapiens
  Payload ID: 12912
  Gene Symbol: PKD1
  Gene Name: polycystic kidney disease 1 (autosomal dominant)
  Uniprot ID: P98161
  ENSP ID: ENSP00000399501
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 64813 - protein, 91 aa, Homo sapiens
  Payload ID: 12912
  Gene Symbol: PKD1
  Gene Name: polycystic kidney disease 1 (autosomal dominant)
  ENSP ID: ENSP00000455753
  MOD_RES (1)..(1): Any amino acid
XVSVAWLLSSSASFLASFLGWEPLKVLLEALYFSLVAKRLHPDEDDTLVESPAVTPVSARVPRVRPPHGFALFLAKEEARKVKRLHGMLRV

SEQ ID NO: 64814 - protein, 155 aa, Homo sapiens
  Payload ID: 12912
  Gene Symbol: PKD1
  Gene Name: polycystic kidney disease 1 (autosomal dominant)
  ENSP ID: ENSP00000456670
  MOD_RES (1)..(1): Any amino acid
XAGVLVDSAVEVAFLWTFGDGEQALHQFQPPYNESFPVPDPSVAQVLVEHNVMHTYAAPGEYLLTVLASNAFENLTQQVLIRSGRVPIVSLECVSCKAQAVYEVSRSSYVYLEGRCLNCSSGSKRGRWAARTFSNKTLVLDETTTSTGSAGMRLV

SEQ ID NO: 64815 - protein, 246 aa, Homo sapiens
  Payload ID: 12912
  Gene Symbol: PKD1
  Gene Name: polycystic kidney disease 1 (autosomal dominant)
  ENSP ID: ENSP00000456672
  MOD_RES (1)..(1): Any amino acid
XDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRHTGPGAGWERVLRPQPGGRRPDAAQFPLGLCGFDTEGGWRVCAELWAPREQHGHHSTGAAGGWRGVHLQPDRVEGRPQGGGHQPDGAD

SEQ ID NO: 64816 - protein, 1122 aa, Homo sapiens
  Payload ID: 12912
  Gene Symbol: PKD1
  Gene Name: polycystic kidney disease 1 (autosomal dominant)
  ENSP ID: ENSP00000457132
PTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKLRQLRQLRCGPAPGLRRCCGHPGQQQPCGRAASAAQLYAAGRPLPV

SEQ ID NO: 64817 - protein, 200 aa, Homo sapiens
  Payload ID: 12912
  Gene Symbol: PKD1
  Gene Name: polycystic kidney disease 1 (autosomal dominant)
  ENSP ID: ENSP00000457162
LLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRGWRWAQRRRARPSAWRAARTGCPGSHTQPQPSTASGSGPPGGVTPTCAQRRTATSASCSPEAQCRMPRTSSWERPVGTCRDP

SEQ ID NO: 64818 - protein, 607 aa, Homo sapiens
  Payload ID: 12912
  Gene Symbol: PKD1
  Gene Name: polycystic kidney disease 1 (autosomal dominant)
  ENSP ID: ENSP00000457984
  MOD_RES (1)..(1): Any amino acid
XETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSK

SEQ ID NO: 64819 - protein, 45 aa, Homo sapiens
  Payload ID: 12912
  Gene Symbol: PKD1
  Gene Name: polycystic kidney disease 1 (autosomal dominant)
  ENSP ID: ENSP00000461391
  MOD_RES (1)..(1): Any amino acid
XGPRVHTCSAAGGFSTSDYDVGWESPHNGSGTWAYSAPDLLGSWA

SEQ ID NO: 64820 - protein, 2849 aa, Homo sapiens
  Payload ID: 12913
  Gene Symbol: PKD1L1
  Gene Name: polycystic kidney disease 1 like 1
  Uniprot ID: Q8TDX9
  ENSP ID: ENSP00000289672
MAEEAAQNISDDQERCLQAACCLSFGGELSVSTDKSWGLHLCSCSPPGGGLWVEVYANHVLLMSDGKCGCPWCALNGKAEDRESQSPSSSASRQKNIWKTTSEAALSVVNEKTQAVVNEKTQAPLDCDNSADRIPHKPFIIIARAWSSGGPRFHHRRLCATGTADSTFSALLQLQGTTSAAAPCSLKMEASCCVLRLLCCAEDVATGLLPGTVTMETPTKVARPTQTSSQRVPLWPISHFPTSPRSSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKGIFFHLLHFQLDMSTYKEAETQNTTLNVYLCQSENSCLEDSDPSNLGYELISAFVTKGVYMLKAVIYNEFHGTEVELGPYYVEIGHEAVSAFMNSSSVHEDEVLVFADSQVNQKSTVVIHHFPSIPSYNVSFISQTQVGDSQAWHSMTVWYKMQSVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQIWRSQPVRLGVTFEAAVFCDISQGLSYTWNLMDSEGLPVSLPAAVDTHRQTLILPSHTLEYGNYTALAKVQIEGSVVYSNYCVGLEVRAQAPVSVISEGTHLFFSRTTSSPIVLRGTQSFDPDDPGATLRYHWECATAGSPAHPCFDSSTAHQLDAAAPTVSFEAQWLSDSYDQFLVMLRVSSGGRNSSETRVFLSPYPDSAFRFVHISWVSFKDTFVNWNDELSLQAMCEDCSEIPNLSYSWDLFLVNATEKNRIEVPFCRVVGLLGSLGLGAISESSQLNLLPTEPGTADPDATTTPFSREPSPVTLGQPATSAPRGTPTEPMTGVYWIPPAGDSAVLGEAPEEGSLDLEPGPQSKGSLMTGRSERSQPTHSPDPHLSDFEAYYSDIQEAIPSGGRQPAKDTSFPGSGPSLSAEESPGDGDNLVDPSLSAGRAEPVLMIDWPKALLGRAVFQGYSSSGITEQTVTIKPYSLSSGETYVLQVSVASKHGLLGKAQLYLTVNPAPRDMACQVQPHHGLEAHTVFSVFCMSGKPDFHYEFSYQIGNTSKHTLYHGRDTQYYFVLPAGEHLDNYKVMVSTEITDGKGSKVQPCTVVVTVLPRYHGNDCLGEDLYNSSLKNLSTLQLMGSYTEIRNYITVITRILSRLSKEDKTASCNQWSRIQDALISSVCRLAFVDQEEMIGSVLMLRDLVSFSNKLGFMSAVLILKYTRALLAQGQFSGPFVIDKGVRLELIGLISRVWEVSEQENSKEEVYRHEEGITVISDLLLGCLSLNHVSTGQMEFRTLLHYNLQSSVQSLGSVQVHLPGDLAGHSPAGAETQSPCYISQLILFKKNPYPGSQAPGQIGGVVGLNLYTCSSRRPINRQWLRKPVMVEFGEEDGLDNRRNKTTFVLLRDKVNLHQFTELSENPQESLQIEIEFSKPVTRAFPVMLLVRFSEKPTPSDFLVKQIYFWDESIVQIYIPAASQKDASVGYLSLLDADYDRKPPNRYLAKAVNYTVHFQWIRCLFWDKREWKSERFSPQPGTSPEKVNCSYHRLAAFALLRRKLKASFEVSDISKLQSHPENLLPSIFIMGSVILYGFLVAKSRQVDHHEKKKAGYIFLQEASLPGHQLYAVVIDTGFRAPARLTSKVYIVLCGDNGLSETKELSCPEKPLFERNSRHTFILSAPAQLGLLRKIRLWHDSRGPSPGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQPHLDVSPTLGSFRVGLLCTLLASPGAQLLSLLFRLSKEAPGSARVEPHSPLRGGAQTEAPHGPNSWGRIPDAQEPRKQPASAILSGSGRAQRKAASDNGTACPAPKLQVHGADHSRTSLMGKSHCCPPHTQAPSSGLEGLMPQWSRALQPWWSSAVWAICGTASLACSLGTGFLAYRFGQEQCVQWLHLLSLSVVCCIFITQPLMVCLMALGFAWKRRADNHFFTESLCEATRDLDSELAERSWTRLPFSSSCSIPDCAGEVEKVLAARQQARHLRWAHPPSKAQLRGTRQRMRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 64821 - protein, 164 aa, Homo sapiens
  Payload ID: 12913
  Gene Symbol: PKD1L1
  Gene Name: polycystic kidney disease 1 like 1
  ENSP ID: ENSP00000393466
  MOD_RES (1)..(1): Any amino acid
XVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLEVASLVSFSFEK

SEQ ID NO: 64822 - protein, 991 aa, Homo sapiens
  Payload ID: 12914
  Gene Symbol: PKD1L2
  Gene Name: polycystic kidney disease 1-like 2 (gene/pseudogene)
  Uniprot ID: Q7Z442
  ENSP ID: ENSP00000337397
MSAVGLVLLVLALRLRATTVKPEEGSFCSNSQVAFRDACYEFVPLGRTFRDAQSWCEGQGGHLVFIQDEGTQWFLQKHISQDREWWIGLTWNLARNGTTEGPGTWLDTSNVTYSNWHGGQAAAAPDTCGHIGRGPSSEWVTSDCAQTFAFMCEFRVGQSLACEGLNATVHCGLGQVIQVQDAVYGRQNPHFCTQDAGRPSDLEQGCSWANVKEEVAGQCQELQSCQVAADETYFGNLCPTQGSYLWVQYQCREALQLMVSSESFIFDNVTISLTWLLSPYIGNLSCIISTGDSHTFDPYNPPSVSSNVTHQFTSPGEFTVFAECTTSEWHVTAQRQVTVRDKMETLSVTACSGLSQSGAGPLCQAVFGDPLWIQVELDGGTGVTYTVLLGDITLAESTTQKGSLPYNLILDRETQKLMGPGRHRLEIQATGNTTTSTISRNITVHLVELLSGLQASWASDHLELGQDLLITISLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQGSCMGDSWEGAPPAAHVSHAR

SEQ ID NO: 64823 - protein, 240 aa, Homo sapiens
  Payload ID: 12914
  Gene Symbol: PKD1L2
  Gene Name: polycystic kidney disease 1-like 2 (gene/pseudogene)
  Uniprot ID: Q7Z442
  ENSP ID: ENSP00000432818
MGEDSPVAMFSWYLDNTPTEQAEPLLDACRLRGFWPRSLTLLQSNTSTLLLNSSFLQSRGEVIRIRATGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVPVGSWGAPFIPFLWGPRVCVRPFGLWIKVHGSGEKPVVSPKRLTPPPSLVFWVSDIK

SEQ ID NO: 64824 - protein, 2442 aa, Homo sapiens
  Payload ID: 12914
  Gene Symbol: PKD1L2
  Gene Name: polycystic kidney disease 1-like 2 (gene/pseudogene)
  ENSP ID: ENSP00000434417
MSAVGLVLLVLALRLRATTVKPEEGSFCSNSQVAFRDACYEFVPLGRTFRDAQSWCEGQGGHLVFIQDEGTQWFLQKHISQDREWWIGLTWNLARNGTTEGPGTWLDTSNVTYSNWHGGQAAAAPDTCGHIGRGPSSEWVTSDCAQTFAFMCEFRVGQSLACEGLNATVHCGLGQVIQVQDAVYGRQNPHFCTQDAGRPSDLEQGCSWANVKEEVAGQCQELQSCQVAADETYFGNLCPTQGSYLWVQYQCREALQLMVSSESFIFDNVTISLTWLLSPYIGNLSCIISTGDSHTFDPYNPPSVSSNVTHQFTSPGEFTVFAECTTSEWHVTAQRQVTVRDKMETLSVTACSGLSQSGAGPLCQAVFGDPLWIQVELDGGTGVTYTVLLGDITLAESTTQKGSLPYNLILDRETQKLMGPGRHRLEIQATGNTTTSTISRNITVHLVELLSGLQASWASDHLELGQDLLITISLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGFITDGNSKLVGSAQIRQVRVQESSCPLAQQPQAYLNGCRAPYSLDAEDMADYGEGWNATTLSNGSTRARTNVKGIPSGANSLCTGEEATWSPWGLIAKARQEFSAISLTTPGWTPPELCLWSPLSTTPTSTCSALSRRRPALWAPFLRTRPCRASACTPSPTAGTPSWRQSSSTSSSSSTTWWCRASAVKRRGAISAASGTFWSWPSSWPAGAPWRCLRGLSWPKGTSSAAGTTGRKASASVRQQQPMPPLATSLPSWYSCPQSFGICSGIPKTSRQPYAVPGATFQALLSSLPCSWLTPSRQTYLVGNSVPTKPSLMRRRRWSAFSWESSTTRRSWTIAQCLAPSSLDPALFLHLWCTCLSLSSWWPSVRSKNTISCRRKGRSICCKYSVSWALSLRERSLEAAGSSLGLCPRLATLDQHKLCPRT

SEQ ID NO: 64825 - protein, 1757 aa, Homo sapiens
  Payload ID: 12914
  Gene Symbol: PKD1L2
  Gene Name: polycystic kidney disease 1-like 2 (gene/pseudogene)
  ENSP ID: ENSP00000434644
MGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGFITDGNSKLVGSAQIRQVRVQESSCPLAQQPQAYLNGCRAPYSLDAEDMADYGEGWNATTLSNGSTRARTNVKGIPSGANSLCTGEEATWSPWGLIAKARQEFSAISLTTPGWTPPELCLWSPLSTTPTSTCSALSRRRPALWAPFLRTRPCRASACTPSPTAGTPSWRQSSSTSSSSSTTWWCRASAVKRRGAISAASGTFWSWPSSWPAGAPWRCLRGLSWPKGTSSAAGTTGRKASASVRQQQPMPPLATSLPSWYSCPQSFGICSGIPKTSRQPYAVPGATFQALLSSLPCSWLTPSRQTYLVGNSVPTKPSLMRRRRWSAFSWESSTTRRSWTIAQCLAPSSLDPALFLHLWCTCLSLSSWWPSVRSKNTISCRRKGRSICCKYSVSWALSLRERSLEAAGSSLGLCPRLATLDQHKLCPRT

SEQ ID NO: 64826 - protein, 306 aa, Homo sapiens; identical to SEQ ID NO: 1125
  Payload ID: 12914
  Gene Symbol: PKD1L2
  Gene Name: polycystic kidney disease 1-like 2 (gene/pseudogene)
  Uniprot ID: Q7Z442
  ENSP ID: ENSP00000436309

SEQ ID NO: 64827 - protein, 519 aa, Homo sapiens
  Payload ID: 12914
  Gene Symbol: PKD1L2
  Gene Name: polycystic kidney disease 1-like 2 (gene/pseudogene)
  ENSP ID: ENSP00000436389
  MOD_RES (1)..(1): Any amino acid
XLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQGSCMGDSWEGAPPAAHVSHAR

SEQ ID NO: 64828 - protein, 2458 aa, Homo sapiens
  Payload ID: 12914
  Gene Symbol: PKD1L2
  Gene Name: polycystic kidney disease 1-like 2 (gene/pseudogene)
  ENSP ID: ENSP00000483832
MSAVGLVLLVLALRLRATTVKPEEGSFCSNSQVAFRDACYEFVPLGRTFRDAQSWCEGQGGHLVFIQDEGTQWFLQKHISQDREWWIGLTWNLARNGTTEGPGTWLDTSNVTYSNWHGGQAAAAPDTCGHIGRGPSSEWVTSDCAQTFAFMCEFRVGQSLACEGLNATVHCGLGQVIQVQDAVYGRQNPHFCTQDAGRPSDLEQGCSWANVKEEVAGQCQELQSCQVAADETYFGNLCPTQGSYLWVQYQCREALQLMVSSESFIFDNVTISLTWLLSPYIGNLSCIISTGDSHTFDPYNPPSVSSNVTHQFTSPGEFTVFAECTTSEWHVTAQRQVTVRDKMETLSVTACSGLSQSGAGPLCQAVFGDPLWIQVELDGGTGVTYTVLLGDITLAESTTQKGSLPYNLILDRETQKLMGPGRHRLEIQATGNTTTSTISRNITVHLVELLSGLQASWASDHLELGQDLLITISLAQGTPEELTFEVAGLNATFSHEQVSFGEPFGICRLAVPVEGTFLVTMLVRNAFSNLSLEIGNITITAPSGLQEPSGMNAEGKSKDKGDMEVYIQPGPYVDPFTTVTLGWPDNDKELRFQWSCGSCWALWSSCVERQLLRTDQRELVVPASCLPPPDSAVTLRLAVLRGQELENRAEQCLYVSAPWELRPRVSCERNCRPVNASKDILLRVTMGEDSPVAMFSWYLDNTPTEQAEPLLDACRLRGFWPRSLTLLQSNTSTLLLNSSFLQSRGEVIRIRATALTRHAYGEDTYVISTVPPREVPACTIAPEEGTVLTSFAIFCNASTALGPLEFCFCLESGSCLHCGPEPALPSVYLPLGEENNDFVLTVVISATNRAGDTQQTQAMAKVALGDTCVEDVAFQAAVSEKIPTALQGEGGPEQLLQLAKAVSSMLNQEHESQGSGQSLSIDVRQKVREHVLGSLSAVTTGLEDVQRVQELAEVLREVTCRSKELTPSAQWEASLALQHASEALLTVSAKARPEDQRRQAATRDLFQAVGSVLEASLSNRPEEPAEASSSQIATVLRLLRVMEHVQTTLLLGKLPGGLPAMLATPSISVYTNRIQPWSWQGSSLRPDAADSATFMLPAASSLSSLEGGQEPVDIKIMSFPKSPFPARSHFDVSGTVGGLRVTSPSGQLIPVKNLSENIEILLPRHSQRHSQPTVLNLTSPEALWVNVTSGEATLGIQLHWRPDIALTLSLGYGYHPNKSSYDAQTHLVPMVAPDELPTWILSPQDLRFGEGVYYLTVVPESDLEPAPGRDLTVGITTFLSHCVFWDEVQETWDDSGCQVGPRTSPYQTHCLCNHLTFFGSTFLVMSNAINIHQTAELFATFEDNPVVVTTVGCLCVVYVLVVIWARRKDAQDQAKVKVTVLEDNDPFAQYHYLVTVYTGHRRGAATSSKVTVTLYGLDGEREPHHLADPDTPVFERGAVDAFLLSTLFPLGELRSLRLWHDNSGDRPSWYVSRVLVYDLVMDRKWYFLCNSWLSINVGDCVLDKVFPVATEQDRKQFSHLFFMKTSAGFQDGHIWYSIFSRCARSSFTRVQRVSCCFSLLLCTMLTSIMFWGVPKDPAEQKMDLGKIEFTWQEVMIGLESSILMFPINLLIVQIFQNTRPRVAKEQNTGKWDRGSPNLTPSPQPMEDGLLTPEAVTKDVSRIVSSLFKALKVPSPALGWDSVNLMDINSLLALVEDVIYPQNTSGQVFWEEAKKREDPVTLTLGSSEMKEKSQCPKPKAARSGPWKDSAYRQCLYLQLEHVEQELRLVGPRGFSQPHSHAQALRQLQTLKGGLGVQPGTWAPAHASALQVSKPPQGLPWWCILVGWLLVAATSGVAAFFTMLYGLHYGRASSLRWLISMAVSFVESMFVTQPLKVLGFAAFFALVLKRVDDEEDTVAPLPGHLLGPDPYALFRARRNSSRDVYQPPLTAAIEKMKTTHLKEQKAFALIREILAYLGFLWMLLLVAYGQRDPSAYHLNRHLQHSFTRGFSGVLGFREFFKWANTTLVSNLYGHPPGFITDGNSKLVGSAQIRQVRVQESSCPLAQQPQAYLNGCRAPYSLDAEDMADYGEGWNATTLSWQYQSQDQRQGYPIWGKLTVYRGGGYVVPLGTDRQSTSRILRYLFDNTWLDALTRAVFVESTVYNANVNLFCIVTLTLETSALGTFFTHAALQSLRLYPFTDGWHPFVVAAELIYFLFLLYYMVVQGKRMSKETWGYFCSKWNLLELAIILASWSALAVFVKRAVLAERDLQRCRNHREEGISFSETAAADAALGYIIAFLVLLSTVKLWHLLRLNPKMNMITAALRRAWGDISGFMIVILTMLLAYSIASNLIFGWKLRSYKTLFDAAETMVSLQLGIFNYEEVLDYSPVLGSFLIGSCIVFMTFVVLNLFISVILVAFSEEQKYYQLSEEGEIVDLLLMKILSFLGIKSKREEPGSSREQPGSLSQTRHSRPAQALPKD

SEQ ID NO: 64829 - protein, 1732 aa, Homo sapiens
  Payload ID: 12915
  Gene Symbol: PKD1L3
  Gene Name: polycystic kidney disease 1-like 3
  Uniprot ID: Q7Z443
  ENSP ID: ENSP00000480090
MFFKGGSWLWLYIRTSIILGSELNSPAPHGQNNCYQLNRFQCSFEEAQHYCHVQRGFLAHIWNKEVQDLIRDYLEEGKKWWIGQNVMPLKKHQDNKYPADVAANGPPKPLSCTYLSRNFIRISSKGDKCLLKYYFICQTGDFLDGDAHYERNGNNSHLYQRHKKTKRGVAIARDKMPPGPGHLPTTCHYPLPAHLSKTLCHPISQFPSVLSSITSQVTSAASEPSSQPLPVITQLTMPVSVTHAGQSLAETTSSPKEEGHPNTFTSYLQVSLQKASGQVIDEIAGNFSRAVHGLQALNKLQEACEFLQKLTALTPRFSKPAQVNLINSLIYLSEELLRIPFQNNNSLGFKVPPTVCPFHSLNNVTKAGEGSWLESKRHTEPVEDILEMSLVEFGNIGEAFLEQNQSPESSVTLTSANATLLLSRQNISTLPLSSYTLGHPAPVRLGFPSALALKELLNKHPGVNVQITGLAFNPFKDLDNRNIVGSIGSVLLSANRKLLQVHDLMEDIEIMLWRNVSLETHPTSLNMSTHQLTITVNVTSLEKSLIVSIDPDSPLLMTLYLGFQYQPNCTHFHLNITLPKDKVWQKDEEYTWVLNPEHLQHGIGTYYITAVLSERQEGAQQTPSLVSVITAVTQCYYWEIHNQTWSSAGCQVGPQSTILRTQCLCNHLTFFASDFFVVPRTVNVEDTIKLFLRVTNNPVGVSLLASLLGFYVITVVWARKKDQADMQKVKVTVLADNDPSAQFHYLIQVYTGYRRSAATTAKVVITLYGSEGRSEPHHLCDPQKTVFERGGLDVFLLTTWTSLGNLHSLRLWHDNSGVSPSWYVSQVIVCDMAVKRKWHFLCNCWLAVDLGDCELDRVFIPVSKRELFSFRHLFSSMIVEKFTQDYLWLSIATRHPWNQFTRVQRLSCCMTLLLCNMVINVMFWKINSTTAKRDEQMRPFAVAWSELLVSIHTAVILFPINLVIGRLFPLIEPQETLPLFPPIQASCLSDASVEPLSATMVVEELKETVRFLLRRNTYLLSKCEQPPWSSWDITKLVKLLSSLVSSHLEGQGCHQQGERHWARVVPENHHHFCCYLHRVLQRLKSHLGTLGLTQGHQSCDFLDAASQLQKLQELLETHILPTEQEPSREVTSFAILSSEEGKKPISNGLSKWLTSVCWLLLGFTSLASAFFTALYSLELSKDQATSWMISIILSVLQNIFISQPVKVVFFTFLYSLMMSRMPRLNKENEQQTKRILALLAKCSSSVPGSRDKNNPVYVAPAINSPTKHPERTLKKKKLFKLTGDILVQILFLTLLMTAIYSAKNSNRFYLHQAIWKTFSHQFSEIKLLQDFYPWANHILLPSLYGDYRGKNAVLEPSHCKCGVQLIFQIPRTKTYEKVDEGQLAFCDNGHTCGRPKSLFPGLHLRRFSYICSPRPMVLIPTDELHERLTSKNENGFSYIMRGAFFTSLRLESFTSLQMSKKGCVWSIISQVIYYLLVCYYAFIQGCQLKQQKWRFFTGKRNILDTSIILISFILLGLDMKSISLHKKNMARYRDDQDRFISFYEAVKVNSAATHLVGFPVLLATVQLWNLLRHSPRLRVISRTLSRAWDEVVGFLLIILILLTGYAIAFNLLFGCSISDYRTFFSSAVTVVGLLMGISHQEEVFALDPVLGTFLILTSVILMVLVVINLFVSAILMAFGKERKSLKKEAALIDTLLQKLSNLLGISWPQKTSSEQAATTAVGSDTEVLDELP

SEQ ID NO: 64830 - protein, 968 aa, Homo sapiens
  Payload ID: 12916
  Gene Symbol: PKD2
  Gene Name: polycystic kidney disease 2 (autosomal dominant)
  Uniprot ID: Q13563
  ENSP ID: ENSP00000237596
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 64831 - protein, 386 aa, Homo sapiens
  Payload ID: 12916
  Gene Symbol: PKD2
  Gene Name: polycystic kidney disease 2 (autosomal dominant)
  ENSP ID: ENSP00000425289
MSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 64832 - protein, 386 aa, Homo sapiens; identical to SEQ ID NO: 64831
  Payload ID: 12916
  Gene Symbol: PKD2
  Gene Name: polycystic kidney disease 2 (autosomal dominant)
  ENSP ID: ENSP00000427131

SEQ ID NO: 64833 - protein, 805 aa, Homo sapiens
  Payload ID: 12917
  Gene Symbol: PKD2L1
  Gene Name: polycystic kidney disease 2-like 1
  Uniprot ID: Q9P0L9
  ENSP ID: ENSP00000325296
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 64834 - protein, 62 aa, Homo sapiens
  Payload ID: 12917
  Gene Symbol: PKD2L1
  Gene Name: polycystic kidney disease 2-like 1
  ENSP ID: ENSP00000434019
  MOD_RES (1)..(1): Any amino acid
XPLQPQPKKPEDEPQETAYRTQVSSCCLHICQGIREVPYKREEEALEERRLSRGEIPTLQRS

SEQ ID NO: 64835 - protein, 71 aa, Homo sapiens
  Payload ID: 12917
  Gene Symbol: PKD2L1
  Gene Name: polycystic kidney disease 2-like 1
  ENSP ID: ENSP00000434224
MNAVGSPEGQELQKLGSGAWDNPAYSGPPSPHGTLRVCTISSTGPLQPQPKKPEDEPQETAYRTQDFGEQP

SEQ ID NO: 64836 - protein, 39 aa, Homo sapiens
  Payload ID: 12917
  Gene Symbol: PKD2L1
  Gene Name: polycystic kidney disease 2-like 1
  ENSP ID: ENSP00000436514
  MOD_RES (1)..(1): Any amino acid
XEPQETAYRTQVSSCCLHICQGIRGISPMPLRTLGNNPD

SEQ ID NO: 64837 - protein, 613 aa, Homo sapiens
  Payload ID: 12918
  Gene Symbol: PKD2L2
  Gene Name: polycystic kidney disease 2-like 2
  Uniprot ID: Q9NZM6
  ENSP ID: ENSP00000290431
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRDGTTTKYKMRFSECLTKRI

SEQ ID NO: 64838 - protein, 57 aa, Homo sapiens
  Payload ID: 12918
  Gene Symbol: PKD2L2
  Gene Name: polycystic kidney disease 2-like 2
  Uniprot ID: Q9NZM6
  ENSP ID: ENSP00000388060
MAEASRWHRGGASKHKLHYRKEVEITTTLQELLLYFIFLINLCICYVISIFGHFCAW

SEQ ID NO: 64839 - protein, 523 aa, Homo sapiens
  Payload ID: 12918
  Gene Symbol: PKD2L2
  Gene Name: polycystic kidney disease 2-like 2
  Uniprot ID: Q9NZM6
  ENSP ID: ENSP00000423382
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 64840 - protein, 84 aa, Homo sapiens
  Payload ID: 12918
  Gene Symbol: PKD2L2
  Gene Name: polycystic kidney disease 2-like 2
  ENSP ID: ENSP00000423926
MEGPLLEGLYWDSWYNNQQLYNLKNSSRIYYENILLGVPRVRQLKVRNNTCKVYSSFQSLMSECYGKYTSANEDLSNFGLQINT

SEQ ID NO: 64841 - protein, 624 aa, Homo sapiens
  Payload ID: 12918
  Gene Symbol: PKD2L2
  Gene Name: polycystic kidney disease 2-like 2
  Uniprot ID: Q9NZM6
  ENSP ID: ENSP00000424725
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 64842 - protein, 182 aa, Homo sapiens
  Payload ID: 12918
  Gene Symbol: PKD2L2
  Gene Name: polycystic kidney disease 2-like 2
  ENSP ID: ENSP00000424885
MEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLL

SEQ ID NO: 64843 - protein, 602 aa, Homo sapiens
  Payload ID: 12918
  Gene Symbol: PKD2L2
  Gene Name: polycystic kidney disease 2-like 2
  Uniprot ID: Q9NZM6
  ENSP ID: ENSP00000425513
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 64844 - protein, 2253 aa, Homo sapiens
  Payload ID: 12919
  Gene Symbol: PKDREJ
  Gene Name: polycystin (PKD) family receptor for egg jelly
  Uniprot ID: Q9NTG1
  ENSP ID: ENSP00000253255
MRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 64845 - protein, 265 aa, Homo sapiens
  Payload ID: 12920
  Gene Symbol: PQBP1
  Gene Name: polyglutamine binding protein 1
  Uniprot ID: O60828
  ENSP ID: ENSP00000218224
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSDAPRGTWSTGLPKRNEAKTGADTTAAGPLFQQRPYPSPGAVLRANAEASRTKQQD

SEQ ID NO: 64846 - protein, 170 aa, Homo sapiens
  Payload ID: 12920
  Gene Symbol: PQBP1
  Gene Name: polyglutamine binding protein 1
  Uniprot ID: O60828
  ENSP ID: ENSP00000247140
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNAAVSRKDEELDPMDPSSYSDAPRGTWSTGLPKRNEAKTGADTTAAGPLFQQRPYPSPGAVLRANAEASRTKQQD

SEQ ID NO: 64847 - protein, 265 aa, Homo sapiens; identical to SEQ ID NO: 64845
  Payload ID: 12920
  Gene Symbol: PQBP1
  Gene Name: polyglutamine binding protein 1
  Uniprot ID: O60828
  ENSP ID: ENSP00000365747

SEQ ID NO: 64848 - protein, 170 aa, Homo sapiens; identical to SEQ ID NO: 64846
  Payload ID: 12920
  Gene Symbol: PQBP1
  Gene Name: polyglutamine binding protein 1
  Uniprot ID: O60828
  ENSP ID: ENSP00000365750

SEQ ID NO: 64849 - protein, 265 aa, Homo sapiens; identical to SEQ ID NO: 64845
  Payload ID: 12920
  Gene Symbol: PQBP1
  Gene Name: polyglutamine binding protein 1
  Uniprot ID: O60828
  ENSP ID: ENSP00000379985

SEQ ID NO: 64850 - protein, 265 aa, Homo sapiens; identical to SEQ ID NO: 64845
  Payload ID: 12920
  Gene Symbol: PQBP1
  Gene Name: polyglutamine binding protein 1
  Uniprot ID: O60828
  ENSP ID: ENSP00000391759

SEQ ID NO: 64851 - protein, 150 aa, Homo sapiens
  Payload ID: 12920
  Gene Symbol: PQBP1
  Gene Name: polyglutamine binding protein 1
  ENSP ID: ENSP00000393013
  MOD_RES (1)..(1): Any amino acid
XIATYLLHLLVQPEEEIIAEDYDDDPVDYEATRLEGLPPSWYKVFDPSCGLPYYWNADTDLVSWLSPHDPNSVVTKSAKKLRSSNAAVSRKDEELDPMDPSSYSDAPRGTWSTGLPKRNEAKTGADTTAAGPLFQQRPYPSPGAVLRANA

SEQ ID NO: 64852 - protein, 213 aa, Homo sapiens
  Payload ID: 12920
  Gene Symbol: PQBP1
  Gene Name: polyglutamine binding protein 1
  ENSP ID: ENSP00000414861
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSDAP

SEQ ID NO: 64853 - protein, 959 aa, Homo sapiens
  Payload ID: 12921
  Gene Symbol: PHC1
  Gene Name: polyhomeotic homolog 1 (Drosophila)
  ENSP ID: ENSP00000399194
METESEQNSNSTNGSSSSGGSSRPQIAQMSLYERQAVQATIAASRQASSPNTSTTQQQTTTTQASINLATTSAAQLISRSQSVSSPSATTLTQSVLLGNTTSPPLNQSQAQMYLRVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 64854 - protein, 182 aa, Homo sapiens
  Payload ID: 12921
  Gene Symbol: PHC1
  Gene Name: polyhomeotic homolog 1 (Drosophila)
  ENSP ID: ENSP00000437459
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASVNRTLGRNVPLASQLILMPNGAVAAVQQEVPSAQSPGVHADADQVQNLAVRNQQASAQGPQMQGSTQKAIPPGASPVSSL

SEQ ID NO: 64855 - protein, 179 aa, Homo sapiens
  Payload ID: 12921
  Gene Symbol: PHC1
  Gene Name: polyhomeotic homolog 1 (Drosophila)
  ENSP ID: ENSP00000437645
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRLGNLLQVNRTLGRNVPLASQLILMPNG

SEQ ID NO: 64856 - protein, 171 aa, Homo sapiens
  Payload ID: 12921
  Gene Symbol: PHC1
  Gene Name: polyhomeotic homolog 1 (Drosophila)
  ENSP ID: ENSP00000437654
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPL

SEQ ID NO: 64857 - protein, 1004 aa, Homo sapiens
  Payload ID: 12921
  Gene Symbol: PHC1
  Gene Name: polyhomeotic homolog 1 (Drosophila)
  Uniprot ID: P78364
  ENSP ID: ENSP00000437659
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 64858 - protein, 1004 aa, Homo sapiens; identical to SEQ ID NO: 64857
  Payload ID: 12921
  Gene Symbol: PHC1
  Gene Name: polyhomeotic homolog 1 (Drosophila)
  Uniprot ID: P78364
  ENSP ID: ENSP00000440674

SEQ ID NO: 64859 - protein, 187 aa, Homo sapiens
  Payload ID: 12921
  Gene Symbol: PHC1
  Gene Name: polyhomeotic homolog 1 (Drosophila)
  ENSP ID: ENSP00000443676
  MOD_RES (1)..(1): Any amino acid
XISSATYTQIQPHSLIQQQQQIHLQQKQVVIQQQIAIHHQQQFQHRQSQLLHTATHLQLAQQQQQQQQQQQQQQQPQATTLTAPQPPQVPPTQQECPPTLAPGMTLAPVQGTAHVVKGGATTSSPVVAQVPAAFYMQSVHLPGKPQTLAVKRKADSEEERDDVSTLGSMLPAKASPVAESPKVMDEK

SEQ ID NO: 64860 - protein, 184 aa, Homo sapiens
  Payload ID: 12921
  Gene Symbol: PHC1
  Gene Name: polyhomeotic homolog 1 (Drosophila)
  ENSP ID: ENSP00000444308
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQSSRRCHLLSLLEFMQMQIRFRTWQ

SEQ ID NO: 64861 - protein, 131 aa, Homo sapiens
  Payload ID: 12921
  Gene Symbol: PHC1
  Gene Name: polyhomeotic homolog 1 (Drosophila)
  ENSP ID: ENSP00000445307
  MOD_RES (1)..(1): Any amino acid
XFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPS

SEQ ID NO: 64862 - protein, 158 aa, Homo sapiens
  Payload ID: 12921
  Gene Symbol: PHC1
  Gene Name: polyhomeotic homolog 1 (Drosophila)
  ENSP ID: ENSP00000445939
METESEQNSNSTNGSSSSGGSSRPQIAQMSLYERQAVQALQALQRQPNAAQYFHQFMLQQQLSNAQLHSLAAVQQVRGQQPAGPRGRGQALQATIAASRQASSPNTSTTQQQTTTTQASINLATTSAAQLISRSQSVSSPSATTLTQSVLLGNTTSPP

SEQ ID NO: 64863 - protein, 99 aa, Homo sapiens
  Payload ID: 12921
  Gene Symbol: PHC1
  Gene Name: polyhomeotic homolog 1 (Drosophila)
  ENSP ID: ENSP00000446388
VPSAQSPGVHADADQVQNLAVRNQQASAQGPQMQGSTQKAIPPGASPVSSLSQASSQALAVAQASSGATNQSLNLSQAGGGSGNSIPGSMGPGGEVGFF

SEQ ID NO: 64864 - protein, 858 aa, Homo sapiens
  Payload ID: 12922
  Gene Symbol: PHC2
  Gene Name: polyhomeotic homolog 2 (Drosophila)
  Uniprot ID: Q8IXK0
  ENSP ID: ENSP00000257118
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 64865 - protein, 323 aa, Homo sapiens
  Payload ID: 12922
  Gene Symbol: PHC2
  Gene Name: polyhomeotic homolog 2 (Drosophila)
  Uniprot ID: Q8IXK0
  ENSP ID: ENSP00000362517
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 64866 - protein, 464 aa, Homo sapiens
  Payload ID: 12922
  Gene Symbol: PHC2
  Gene Name: polyhomeotic homolog 2 (Drosophila)
  ENSP ID: ENSP00000362521
MPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 64867 - protein, 830 aa, Homo sapiens
  Payload ID: 12922
  Gene Symbol: PHC2
  Gene Name: polyhomeotic homolog 2 (Drosophila)
  ENSP ID: ENSP00000389436
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 64868 - protein, 223 aa, Homo sapiens
  Payload ID: 12923
  Gene Symbol: PHC3
  Gene Name: polyhomeotic homolog 3 (Drosophila)
  ENSP ID: ENSP00000417360
  MOD_RES (1)..(1): Any amino acid
XSEEELPAAEALVQLPFQTLPPPQTVAVNLQVQPPAPVDPPVGMHLNQCHLHKVFSLKVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSSKHICVCVCNLYNIILKVTYYCSLIKSL

SEQ ID NO: 64869 - protein, 147 aa, Homo sapiens
  Payload ID: 12923
  Gene Symbol: PHC3
  Gene Name: polyhomeotic homolog 3 (Drosophila)
  ENSP ID: ENSP00000417540
MAEAEFKDHSTAMDTEPNPGTSSVSTTTSSTTTTTITTSSSRMQQPQISVYSGSDRHAVQALHRPPSSAAQYLQQMYAAQQQHLMLHTAALQQQHLSSSQLQSLAAVQASLSSGRPSTSPTGSVTQQSSMSQTSVSSLNFFFLDLKF

SEQ ID NO: 64870 - protein, 199 aa, Homo sapiens
  Payload ID: 12923
  Gene Symbol: PHC3
  Gene Name: polyhomeotic homolog 3 (Drosophila)
  ENSP ID: ENSP00000417633
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSNQPLHFSYTCTVNKPFPGFQFYQRQYYPTDYVTREYFPYPNGKPSSNVSPSSNADFHTRYHCGCCTV

SEQ ID NO: 64871 - protein, 182 aa, Homo sapiens
  Payload ID: 12923
  Gene Symbol: PHC3
  Gene Name: polyhomeotic homolog 3 (Drosophila)
  ENSP ID: ENSP00000417860
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSVQNLTLRSQKLGVLSSSQNGPPKSTSQTQSLTICHNKTTVTSSK

SEQ ID NO: 64872 - protein, 214 aa, Homo sapiens
  Payload ID: 12923
  Gene Symbol: PHC3
  Gene Name: polyhomeotic homolog 3 (Drosophila)
  ENSP ID: ENSP00000418039
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSTSYSPIQPHSLIKHQQIPLHSPPSKVSHHQLILQQQQQQIQPITLQNSTQDPPPSQHCIPLQNHGLPPAPSNAQSQHCSPIQ

SEQ ID NO: 64873 - protein, 161 aa, Homo sapiens
  Payload ID: 12923
  Gene Symbol: PHC3
  Gene Name: polyhomeotic homolog 3 (Drosophila)
  ENSP ID: ENSP00000418835
  MOD_RES (1)..(1): Any amino acid
XRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 64874 - protein, 828 aa, Homo sapiens
  Payload ID: 12923
  Gene Symbol: PHC3
  Gene Name: polyhomeotic homolog 3 (Drosophila)
  ENSP ID: ENSP00000419089
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPQMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSRSSLLIEQPVKKRPLLDNQVINSVCVQPELQNNTKHADNSSDTEMEDMIAEETLEEMDSELLKCEFCGKMGYANEFLRSKRFCTMSCAKRYNVSCSKKFALSRWNRKPDNQSLGHRGRRPSGPDGAAREHILRQKKTWLLMKILCHLL

SEQ ID NO: 64875 - protein, 247 aa, Homo sapiens
  Payload ID: 12923
  Gene Symbol: PHC3
  Gene Name: polyhomeotic homolog 3 (Drosophila)
  ENSP ID: ENSP00000419899
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPK

SEQ ID NO: 64876 - protein, 983 aa, Homo sapiens
  Payload ID: 12923
  Gene Symbol: PHC3
  Gene Name: polyhomeotic homolog 3 (Drosophila)
  Uniprot ID: Q8NDX5
  ENSP ID: ENSP00000420271
MDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPQMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSRSSLLIEQPVKKRPLLDNQVINSVCVQPELQNNTKHADNSSDTEMEDMIAEETLEEMDSELLKCEFCGKMGYANEFLRSKRFCTMSCAKRYNVSCSKKFALSRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 64877 - protein, 995 aa, Homo sapiens
  Payload ID: 12923
  Gene Symbol: PHC3
  Gene Name: polyhomeotic homolog 3 (Drosophila)
  Uniprot ID: Q8NDX5
  ENSP ID: ENSP00000420294
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPQMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSRSSLLIEQPVKKRPLLDNQVINSVCVQPELQNNTKHADNSSDTEMEDMIAEETLEEMDSELLKCEFCGKMGYANEFLRSKRFCTMSCAKRYNVSCSKKFALSRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 64878 - protein, 151 aa, Homo sapiens
  Payload ID: 12923
  Gene Symbol: PHC3
  Gene Name: polyhomeotic homolog 3 (Drosophila)
  Uniprot ID: Q8NDX5
  ENSP ID: ENSP00000420454
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSVSSLNFFFLDLKF

SEQ ID NO: 64879 - protein, 57 aa, Homo sapiens
  Payload ID: 12923
  Gene Symbol: PHC3
  Gene Name: polyhomeotic homolog 3 (Drosophila)
  ENSP ID: ENSP00000420713
MDTEPNPGTSSVSTTTSSTTTTTITTSSSRMQQPQISVYSGSDRHAVQELYSLGYET

SEQ ID NO: 64880 - protein, 678 aa, Homo sapiens
  Payload ID: 12924
  Gene Symbol: POLI
  Gene Name: polymerase (DNA directed) iota
  ENSP ID: ENSP00000217800
VHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 64881 - protein, 661 aa, Homo sapiens
  Payload ID: 12924
  Gene Symbol: POLI
  Gene Name: polymerase (DNA directed) iota
  ENSP ID: ENSP00000385196
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQCIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 64882 - protein, 145 aa, Homo sapiens
  Payload ID: 12924
  Gene Symbol: POLI
  Gene Name: polymerase (DNA directed) iota
  ENSP ID: ENSP00000461983
MNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLP

SEQ ID NO: 64883 - protein, 85 aa, Homo sapiens
  Payload ID: 12924
  Gene Symbol: POLI
  Gene Name: polymerase (DNA directed) iota
  ENSP ID: ENSP00000462146
AKCLEALGINSVRDLQTFSPKILEKELGISVAQRIQKLSFGEDNSPVILSGPPQSFSEEDSFKKCSSEVEAKNKIEELLASLLNR

SEQ ID NO: 64884 - protein, 740 aa, Homo sapiens
  Payload ID: 12924
  Gene Symbol: POLI
  Gene Name: polymerase (DNA directed) iota
  Uniprot ID: Q9UNA4
  ENSP ID: ENSP00000462664
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 64885 - protein, 637 aa, Homo sapiens
  Payload ID: 12924
  Gene Symbol: POLI
  Gene Name: polymerase (DNA directed) iota
  ENSP ID: ENSP00000462681
MNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 64886 - protein, 142 aa, Homo sapiens
  Payload ID: 12924
  Gene Symbol: POLI
  Gene Name: polymerase (DNA directed) iota
  ENSP ID: ENSP00000463065
  MOD_RES (1)..(1): Any amino acid
XSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGLQSPDFCASSLMQRRLEDKLVKLEGVFTKH

SEQ ID NO: 64887 - protein, 222 aa, Homo sapiens
  Payload ID: 12924
  Gene Symbol: POLI
  Gene Name: polymerase (DNA directed) iota
  ENSP ID: ENSP00000463071
MISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFS

SEQ ID NO: 64888 - protein, 52 aa, Homo sapiens
  Payload ID: 12924
  Gene Symbol: POLI
  Gene Name: polymerase (DNA directed) iota
  ENSP ID: ENSP00000463971
CLEALGINSVRDLQTFSPKILEKELGISVAQRIQKLSFGEDNSPVILSGPPQ

SEQ ID NO: 64889 - protein, 195 aa, Homo sapiens
  Payload ID: 12924
  Gene Symbol: POLI
  Gene Name: polymerase (DNA directed) iota
  ENSP ID: ENSP00000464025
  MOD_RES (1)..(1): Any amino acid
XKLGVEPEEEGGGDDDEEDAEAWAMELADVGAAASSQGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVF

SEQ ID NO: 64890 - protein, 870 aa, Homo sapiens
  Payload ID: 12925
  Gene Symbol: POLK
  Gene Name: polymerase (DNA directed) kappa
  Uniprot ID: Q9UBT6
  ENSP ID: ENSP00000241436
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 64891 - protein, 90 aa, Homo sapiens
  Payload ID: 12925
  Gene Symbol: POLK
  Gene Name: polymerase (DNA directed) kappa
  ENSP ID: ENSP00000420997
MDSTKEKCDSYKDDLLLRMGLNDNKAGMEGLDKEKINKIIMEATKGSRFYGNELKKEKQVNQRIENMMQQKAQITSQQLRKAQLQINIKF

SEQ ID NO: 64892 - protein, 90 aa, Homo sapiens; identical to SEQ ID NO: 64891
  Payload ID: 12925
  Gene Symbol: POLK
  Gene Name: polymerase (DNA directed) kappa
  ENSP ID: ENSP00000421879

SEQ ID NO: 64893 - protein, 396 aa, Homo sapiens
  Payload ID: 12925
  Gene Symbol: POLK
  Gene Name: polymerase (DNA directed) kappa
  ENSP ID: ENSP00000421997
MMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKKKYLPLLRNC

SEQ ID NO: 64894 - protein, 372 aa, Homo sapiens
  Payload ID: 12925
  Gene Symbol: POLK
  Gene Name: polymerase (DNA directed) kappa
  Uniprot ID: Q9UBT6
  ENSP ID: ENSP00000422094
MELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKKKYLPLLRNC

SEQ ID NO: 64895 - protein, 427 aa, Homo sapiens
  Payload ID: 12925
  Gene Symbol: POLK
  Gene Name: polymerase (DNA directed) kappa
  ENSP ID: ENSP00000423526
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERVELLPLS

SEQ ID NO: 64896 - protein, 489 aa, Homo sapiens
  Payload ID: 12925
  Gene Symbol: POLK
  Gene Name: polymerase (DNA directed) kappa
  Uniprot ID: Q9UBT6
  ENSP ID: ENSP00000423532
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVFGYLVFPMKRTGNTNKGALLAFYRLETKPCQPLSVH

SEQ ID NO: 64897 - protein, 472 aa, Homo sapiens
  Payload ID: 12925
  Gene Symbol: POLK
  Gene Name: polymerase (DNA directed) kappa
  Uniprot ID: Q9UBT6
  ENSP ID: ENSP00000424174
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVLYFDMVSLVFKFFNSKMLP

SEQ ID NO: 64898 - protein, 90 aa, Homo sapiens; identical to SEQ ID NO: 64891
  Payload ID: 12925
  Gene Symbol: POLK
  Gene Name: polymerase (DNA directed) kappa
  ENSP ID: ENSP00000424859

SEQ ID NO: 64899 - protein, 461 aa, Homo sapiens
  Payload ID: 12925
  Gene Symbol: POLK
  Gene Name: polymerase (DNA directed) kappa
  Uniprot ID: Q9UBT6
  ENSP ID: ENSP00000425075
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVAQVEYRRL

SEQ ID NO: 64900 - protein, 141 aa, Homo sapiens
  Payload ID: 12925
  Gene Symbol: POLK
  Gene Name: polymerase (DNA directed) kappa
  ENSP ID: ENSP00000425208
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNY

SEQ ID NO: 64901 - protein, 672 aa, Homo sapiens
  Payload ID: 12925
  Gene Symbol: POLK
  Gene Name: polymerase (DNA directed) kappa
  Uniprot ID: Q9UBT6
  ENSP ID: ENSP00000426853
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 64902 - protein, 900 aa, Homo sapiens
  Payload ID: 12926
  Gene Symbol: POLN
  Gene Name: polymerase (DNA directed) nu
  Uniprot ID: Q7Z5Q5
  ENSP ID: ENSP00000372316
MENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 64903 - protein, 524 aa, Homo sapiens
  Payload ID: 12926
  Gene Symbol: POLN
  Gene Name: polymerase (DNA directed) nu
  ENSP ID: ENSP00000426401
  MOD_RES (1)..(1): Any amino acid
XLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEALNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVPLKVSLSAGRSWGHLVPLQEAWGPPPGPCRTESPSNSLAAPGSPASTQPPPLHFSPSFCL

SEQ ID NO: 64904 - protein, 900 aa, Homo sapiens; identical to SEQ ID NO: 64902
  Payload ID: 12926
  Gene Symbol: POLN
  Gene Name: polymerase (DNA directed) nu
  Uniprot ID: Q7Z5Q5
  ENSP ID: ENSP00000435506

SEQ ID NO: 64905 - protein, 1462 aa, Homo sapiens
  Payload ID: 12927
  Gene Symbol: POLA1
  Gene Name: polymerase (DNA directed), alpha 1, catalytic subunit
  Uniprot ID: P09884
  ENSP ID: ENSP00000368349
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 64906 - protein, 1468 aa, Homo sapiens
  Payload ID: 12927
  Gene Symbol: POLA1
  Gene Name: polymerase (DNA directed), alpha 1, catalytic subunit
  ENSP ID: ENSP00000368358
MAPVHGDDCEIGASALSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 64907 - protein, 1461 aa, Homo sapiens [sequence omitted]

SEQ ID NO: 64908 - protein, 598 aa, Homo sapiens
  Payload ID: 12928
  Gene Symbol: POLA2
  Gene Name: polymerase (DNA directed), alpha 2, accessory subunit
  Uniprot ID: Q14181
  ENSP ID: ENSP00000265465
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKDVLGCVCVNPGRLTKGQVGGTFARLYLRRPAADGAERQSPCIAVQVVRI

SEQ ID NO: 64909 - protein, 37 aa, Homo sapiens
  Payload ID: 12928
  Gene Symbol: POLA2
  Gene Name: polymerase (DNA directed), alpha 2, accessory subunit
  ENSP ID: ENSP00000432536
MSASAQQLAEELQIFGLDCEEALIEKFSEQKIIESQA

SEQ ID NO: 64910 - protein, 146 aa, Homo sapiens
  Payload ID: 12928
  Gene Symbol: POLA2
  Gene Name: polymerase (DNA directed), alpha 2, accessory subunit
  ENSP ID: ENSP00000433952
MVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRG

SEQ ID NO: 64911 - protein, 261 aa, Homo sapiens
  Payload ID: 12928
  Gene Symbol: POLA2
  Gene Name: polymerase (DNA directed), alpha 2, accessory subunit
  ENSP ID: ENSP00000434173
  MOD_RES (1)..(1): Any amino acid
XEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKFLPFRWTKIKIGGNQGLVSLRRNSPVDCVGAWYLAQSPRRTS

SEQ ID NO: 64912 - protein, 335 aa, Homo sapiens
  Payload ID: 12929
  Gene Symbol: POLB
  Gene Name: polymerase (DNA directed), beta
  Uniprot ID: P06746
  ENSP ID: ENSP00000265421
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 64913 - protein, 42 aa, Homo sapiens
  Payload ID: 12929
  Gene Symbol: POLB
  Gene Name: polymerase (DNA directed), beta
  ENSP ID: ENSP00000427799
MSKRKAPQETLNGGITDMLTELANFEKNVSQAIHKYNAYSLE

SEQ ID NO: 64914 - protein, 106 aa, Homo sapiens
  Payload ID: 12929
  Gene Symbol: POLB
  Gene Name: polymerase (DNA directed), beta
  ENSP ID: ENSP00000428144
  MOD_RES (1)..(1): Any amino acid
XESSGDMDVLLTHPSFTSESTKQPKLLHQVVEQLQKVHFITDTLSKGETKFMELQENPCQWIVKKTSLITSSGNTGNPRTGANEACILPGRHNPIGVLIYFLTFAM

SEQ ID NO: 64915 - protein, 29 aa, Homo sapiens
  Payload ID: 12929
  Gene Symbol: POLB
  Gene Name: polymerase (DNA directed), beta
  ENSP ID: ENSP00000428578
ASVIAKYPHKIKSGAEAKKLSICCKEVCR

SEQ ID NO: 64916 - protein, 193 aa, Homo sapiens
  Payload ID: 12929
  Gene Symbol: POLB
  Gene Name: polymerase (DNA directed), beta
  ENSP ID: ENSP00000429436
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRDSAVYINTPE

SEQ ID NO: 64917 - protein, 237 aa, Homo sapiens
  Payload ID: 12929
  Gene Symbol: POLB
  Gene Name: polymerase (DNA directed), beta
  ENSP ID: ENSP00000429597
  MOD_RES (1)..(1): Any amino acid
XEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 64918 - protein, 239 aa, Homo sapiens
  Payload ID: 12929
  Gene Symbol: POLB
  Gene Name: polymerase (DNA directed), beta
  ENSP ID: ENSP00000430478
  MOD_RES (1)..(1): Any amino acid
XGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTVLQATREDLMHNMLLGPQLKAIKELQENPCQWIVKKTSLITSSGNTGNPRTGANEACILPGRHNPIGVLIYFLTFAM

SEQ ID NO: 64919 - protein, 51 aa, Homo sapiens
  Payload ID: 12929
  Gene Symbol: POLB
  Gene Name: polymerase (DNA directed), beta
  ENSP ID: ENSP00000430610
MLQMQDIVLNEVKKVDSEYIATVCGSFRRGAESSGDMDVLLTHPSFTSEST

SEQ ID NO: 64920 - protein, 280 aa, Homo sapiens
  Payload ID: 12929
  Gene Symbol: POLB
  Gene Name: polymerase (DNA directed), beta
  ENSP ID: ENSP00000430784
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEGSQLDSCPVKGHLNGTESLLDLIWDVMTILKLKNADLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKN

SEQ ID NO: 64921 - protein, 54 aa, Homo sapiens
  Payload ID: 12929
  Gene Symbol: POLB
  Gene Name: polymerase (DNA directed), beta
  ENSP ID: ENSP00000430831
MRAHALEKGFTINEYTIRPLGVTGVAGEPLPVDSEKDIFDYIQWKYREPKDRSE

SEQ ID NO: 64922 - protein, 38 aa, Homo sapiens
  Payload ID: 12929
  Gene Symbol: POLB
  Gene Name: polymerase (DNA directed), beta
  ENSP ID: ENSP00000432084
MTILKLKNADLRKNEDKLNHHQRIGLKYFGDFEKRIPR

SEQ ID NO: 64923 - protein, 1107 aa, Homo sapiens
  Payload ID: 12930
  Gene Symbol: POLD1
  Gene Name: polymerase (DNA directed), delta 1, catalytic subunit
  Uniprot ID: P28340
  ENSP ID: ENSP00000406046
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 64924 - protein, 289 aa, Homo sapiens
  Payload ID: 12930
  Gene Symbol: POLD1
  Gene Name: polymerase (DNA directed), delta 1, catalytic subunit
  ENSP ID: ENSP00000469115
  MOD_RES (1)..(1): Any amino acid
XYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERSCAGMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEF

SEQ ID NO: 64925 - protein, 291 aa, Homo sapiens
  Payload ID: 12930
  Gene Symbol: POLD1
  Gene Name: polymerase (DNA directed), delta 1, catalytic subunit
  ENSP ID: ENSP00000469308
  MOD_RES (1)..(1): Any amino acid
XEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGIPSECPGGALLAPLDAVPALPGQPARGRHLHQPGLPHLLHAQEGAEGPGRPGAAPAALR

SEQ ID NO: 64926 - protein, 188 aa, Homo sapiens
  Payload ID: 12930
  Gene Symbol: POLD1
  Gene Name: polymerase (DNA directed), delta 1, catalytic subunit
  ENSP ID: ENSP00000470426
  MOD_RES (1)..(1): Any amino acid
XVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKSVTGFGRQMIEKTKQLVESKYTVEN

SEQ ID NO: 64927 - protein, 1009 aa, Homo sapiens
  Payload ID: 12930
  Gene Symbol: POLD1
  Gene Name: polymerase (DNA directed), delta 1, catalytic subunit
  ENSP ID: ENSP00000470726
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERTRCSCWSTACPLTRSTTWSSSWPSPSCASSSPSWARAVPRLCYCGGTTRAARRCSRARWAASWPSPNAATAALAAAQCSATREPCVSSASPGSLSCIRRRYPI

SEQ ID NO: 64928 - protein, 1133 aa, Homo sapiens
  Payload ID: 12930
  Gene Symbol: POLD1
  Gene Name: polymerase (DNA directed), delta 1, catalytic subunit
  ENSP ID: ENSP00000472445
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGVRPQDRAGAAWELLALTPGRGCSPPRYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 64929 - protein, 202 aa, Homo sapiens
  Payload ID: 12930
  Gene Symbol: POLD1
  Gene Name: polymerase (DNA directed), delta 1, catalytic subunit
  ENSP ID: ENSP00000472600
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESECSPR

SEQ ID NO: 64930 - protein, 105 aa, Homo sapiens
  Payload ID: 12930
  Gene Symbol: POLD1
  Gene Name: polymerase (DNA directed), delta 1, catalytic subunit
  ENSP ID: ENSP00000472607
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYV

SEQ ID NO: 64931 - protein, 1107 aa, Homo sapiens; identical to SEQ ID NO: 64923
  Payload ID: 12930
  Gene Symbol: POLD1
  Gene Name: polymerase (DNA directed), delta 1, catalytic subunit
  Uniprot ID: P28340
  ENSP ID: ENSP00000473052

SEQ ID NO: 64932 - protein, 1133 aa, Homo sapiens; identical to SEQ ID NO: 64928
  Payload ID: 12930
  Gene Symbol: POLD1
  Gene Name: polymerase (DNA directed), delta 1, catalytic subunit
  ENSP ID: ENSP00000481858

SEQ ID NO: 64933 - protein, 455 aa, Homo sapiens
  Payload ID: 12931
  Gene Symbol: POLD2
  Gene Name: polymerase (DNA directed), delta 2, accessory subunit
  ENSP ID: ENSP00000223361
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLECPHVYFCGNTPSFGSKIIRGPEDQTVLLVTVPDFSATQTACLVNLRSLACQPISFSGFGAEDDDLGGLGLGP

SEQ ID NO: 64934 - protein, 469 aa, Homo sapiens
  Payload ID: 12931
  Gene Symbol: POLD2
  Gene Name: polymerase (DNA directed), delta 2, accessory subunit
  Uniprot ID: P49005
  ENSP ID: ENSP00000386105
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 64935 - protein, 220 aa, Homo sapiens
  Payload ID: 12931
  Gene Symbol: POLD2
  Gene Name: polymerase (DNA directed), delta 2, accessory subunit
  ENSP ID: ENSP00000389816
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVD

SEQ ID NO: 64936 - protein, 469 aa, Homo sapiens; identical to SEQ ID NO: 64934
  Payload ID: 12931
  Gene Symbol: POLD2
  Gene Name: polymerase (DNA directed), delta 2, accessory subunit
  Uniprot ID: P49005
  ENSP ID: ENSP00000395231

SEQ ID NO: 64937 - protein, 155 aa, Homo sapiens
  Payload ID: 12931
  Gene Symbol: POLD2
  Gene Name: polymerase (DNA directed), delta 2, accessory subunit
  ENSP ID: ENSP00000397461
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVT

SEQ ID NO: 64938 - protein, 83 aa, Homo sapiens
  Payload ID: 12931
  Gene Symbol: POLD2
  Gene Name: polymerase (DNA directed), delta 2, accessory subunit
  ENSP ID: ENSP00000399447
AKYLTKKTQAASVEAVKMLDEILLQLSQPLHPCMFPLATAYSTLQLVTNPYQATIDGVRFLGTSGQNVSDIFRYSSMEDHLEI

SEQ ID NO: 64939 - protein, 148 aa, Homo sapiens
  Payload ID: 12931
  Gene Symbol: POLD2
  Gene Name: polymerase (DNA directed), delta 2, accessory subunit
  ENSP ID: ENSP00000406702
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTI

SEQ ID NO: 64940 - protein, 257 aa, Homo sapiens
  Payload ID: 12931
  Gene Symbol: POLD2
  Gene Name: polymerase (DNA directed), delta 2, accessory subunit
  ENSP ID: ENSP00000416203
MFSEQAAQRAHTLLSPPSANNATFARVPVATYTNSSQPFRLGERSFSRQYAHIYATRLIQMRPFLENRAQQHWGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGV

SEQ ID NO: 64941 - protein, 504 aa, Homo sapiens
  Payload ID: 12931
  Gene Symbol: POLD2
  Gene Name: polymerase (DNA directed), delta 2, accessory subunit
  ENSP ID: ENSP00000480186
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 64942 - protein, 527 aa, Homo sapiens
  Payload ID: 12932
  Gene Symbol: POLE2
  Gene Name: polymerase (DNA directed), epsilon 2, accessory subunit
  Uniprot ID: P56282
  ENSP ID: ENSP00000216367
MAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPGSFPRSGFSFKVFYPSNKTVEDSKLQGF

SEQ ID NO: 64943 - protein, 501 aa, Homo sapiens
  Payload ID: 12932
  Gene Symbol: POLE2
  Gene Name: polymerase (DNA directed), epsilon 2, accessory subunit
  Uniprot ID: P56282
  ENSP ID: ENSP00000446313
MAPERLRSRALSAFKLRGLLLRGEAIKYLTEALQSISELELEDKLEKIINAVEKQPLSSNMIERSVVEAAVQECSQSVDETILLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPGSFPRSGFSFKVFYPSNKTVEDSKLQGF

SEQ ID NO: 64944 - protein, 502 aa, Homo sapiens
  Payload ID: 12932
  Gene Symbol: POLE2
  Gene Name: polymerase (DNA directed), epsilon 2, accessory subunit
  Uniprot ID: P56282
  ENSP ID: ENSP00000451621
MAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPVRM

SEQ ID NO: 64945 - protein, 96 aa, Homo sapiens
  Payload ID: 12932
  Gene Symbol: POLE2
  Gene Name: polymerase (DNA directed), epsilon 2, accessory subunit
  ENSP ID: ENSP00000475468
MAPERLRSRALSAFKLRGLLLRGEAIKYLTEALQSISELELEDKLEKIINAVEKQPLSSNMIERSVVEAAVQECSQSVDETMYVGTVNFFPPWRCY

SEQ ID NO: 64946 - protein, 147 aa, Homo sapiens
  Payload ID: 12933
  Gene Symbol: POLE3
  Gene Name: polymerase (DNA directed), epsilon 3, accessory subunit
  Uniprot ID: Q9NRF9
  ENSP ID: ENSP00000363284
MAERPEDLNLPNAVITRIIKEALPDGVNISKEARSAISRAASVFVLYATSCANNFAMKGKRKTLNASDVLSAMEEMEFQRFVTPLKEALEAYRREQKGKKEASEQKKKDKDKKTDSEEQDKSRDEDNDEDEERLEEEEQNEEEEVDN

SEQ ID NO: 64947 - protein, 147 aa, Homo sapiens; identical to SEQ ID NO: 64946
  Payload ID: 12933
  Gene Symbol: POLE3
  Gene Name: polymerase (DNA directed), epsilon 3, accessory subunit
  Uniprot ID: Q9NRF9
  ENSP ID: ENSP00000363286

SEQ ID NO: 64948 - protein, 2286 aa, Homo sapiens
  Payload ID: 12934
  Gene Symbol: POLE
  Gene Name: polymerase (DNA directed), epsilon, catalytic subunit
  Uniprot ID: Q07864
  ENSP ID: ENSP00000322570
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 64949 - protein, 310 aa, Homo sapiens
  Payload ID: 12934
  Gene Symbol: POLE
  Gene Name: polymerase (DNA directed), epsilon, catalytic subunit
  ENSP ID: ENSP00000442578
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGDCFRRY

SEQ ID NO: 64950 - protein, 2259 aa, Homo sapiens
  Payload ID: 12934
  Gene Symbol: POLE
  Gene Name: polymerase (DNA directed), epsilon, catalytic subunit
  ENSP ID: ENSP00000445753
MSLRSGGRRRADPGADGEASRDDGATSSVSALKRLERSQWTDKMDLRFGFERLKEPGEKTGWLINMHPVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 64951 - protein, 150 aa, Homo sapiens
  Payload ID: 12934
  Gene Symbol: POLE
  Gene Name: polymerase (DNA directed), epsilon, catalytic subunit
  ENSP ID: ENSP00000479927
  MOD_RES (1)..(1): Any amino acid
XSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGLCRK

SEQ ID NO: 64952 - protein, 154 aa, Homo sapiens
  Payload ID: 12934
  Gene Symbol: POLE
  Gene Name: polymerase (DNA directed), epsilon, catalytic subunit
  ENSP ID: ENSP00000480727
  MOD_RES (1)..(1): Any amino acid
XISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPDSEESHRLSELH

SEQ ID NO: 64953 - protein, 414 aa, Homo sapiens
  Payload ID: 12935
  Gene Symbol: POLH
  Gene Name: polymerase (DNA directed), eta
  Uniprot ID: Q9Y253
  ENSP ID: ENSP00000361300
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 64954 - protein, 713 aa, Homo sapiens
  Payload ID: 12935
  Gene Symbol: POLH
  Gene Name: polymerase (DNA directed), eta
  Uniprot ID: Q9Y253
  ENSP ID: ENSP00000361310
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 64955 - protein, 71 aa, Homo sapiens
  Payload ID: 12935
  Gene Symbol: POLH
  Gene Name: polymerase (DNA directed), eta
  ENSP ID: ENSP00000405320
MWADDAKKLCPDLLLAQVRESRGKANLTKYREASVEVMEIMSRFAVIERASIDEAYVDLTSAVQERLQKLQ

SEQ ID NO: 64956 - protein, 1239 aa, Homo sapiens
  Payload ID: 12936
  Gene Symbol: POLG
  Gene Name: polymerase (DNA directed), gamma
  Uniprot ID: P54098
  ENSP ID: ENSP00000268124
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 64957 - protein, 1239 aa, Homo sapiens; identical to SEQ ID NO: 64956
  Payload ID: 12936
  Gene Symbol: POLG
  Gene Name: polymerase (DNA directed), gamma
  Uniprot ID: P54098
  ENSP ID: ENSP00000399851

SEQ ID NO: 64958 - protein, 68 aa, Homo sapiens
  Payload ID: 12936
  Gene Symbol: POLG
  Gene Name: polymerase (DNA directed), gamma
  ENSP ID: ENSP00000431395
WFFKLPHKDGNSCNVGSPFAKDFLPKMEDGTLQAGPGGASGPRALEINKMISFWRNAHKRISPLLSAY

SEQ ID NO: 64959 - protein, 233 aa, Homo sapiens
  Payload ID: 12936
  Gene Symbol: POLG
  Gene Name: polymerase (DNA directed), gamma
  ENSP ID: ENSP00000432389
  MOD_RES (1)..(1): Any amino acid
XQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALDGNSCNVGSPFAKDFLPKMEDGTLQAGPGGASGPRALEINKMISFWRNAHKRI

SEQ ID NO: 64960 - protein, 196 aa, Homo sapiens
  Payload ID: 12936
  Gene Symbol: POLG
  Gene Name: polymerase (DNA directed), gamma
  ENSP ID: ENSP00000432885
LTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTSKIPSSYG

SEQ ID NO: 64961 - protein, 69 aa, Homo sapiens
  Payload ID: 12936
  Gene Symbol: POLG
  Gene Name: polymerase (DNA directed), gamma
  ENSP ID: ENSP00000433502
  MOD_RES (1)..(1): Any amino acid
XPGCWFFKLPHKDGNSCNVGSPFAKDFLPKMEDGTLQAGPGGASGPRALEINKMISFWRNAHKRISLTE

SEQ ID NO: 64962 - protein, 51 aa, Homo sapiens
  Payload ID: 12936
  Gene Symbol: POLG
  Gene Name: polymerase (DNA directed), gamma
  ENSP ID: ENSP00000434937
  MOD_RES (1)..(1): Any amino acid
XLTWDGFPLHYSERHGWGYLVPGRRDNLAKLPTGTTLESAGVVCPYRGSSS

SEQ ID NO: 64963 - protein, 257 aa, Homo sapiens
  Payload ID: 12936
  Gene Symbol: POLG
  Gene Name: polymerase (DNA directed), gamma
  ENSP ID: ENSP00000486730
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWIKILFTTLMLSGMASKKVGSFFIPIGSYIFVKKAAKC

SEQ ID NO: 64964 - protein, 485 aa, Homo sapiens
  Payload ID: 12937
  Gene Symbol: POLG2
  Gene Name: polymerase (DNA directed), gamma 2, accessory subunit
  Uniprot ID: Q9UHN1
  ENSP ID: ENSP00000442563
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQVCQGLFNELLENGISVWPGYLETMQSSLEQLYSKYDEMSILFTVLVTETTLENGLIHLRSRDTTMKEMMHISKLKDFLIKYISSAKNV

SEQ ID NO: 64965 - protein, 151 aa, Homo sapiens
  Payload ID: 12937
  Gene Symbol: POLG2
  Gene Name: polymerase (DNA directed), gamma 2, accessory subunit
  ENSP ID: ENSP00000462071
SNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQV

SEQ ID NO: 64966 - protein, 81 aa, Homo sapiens
  Payload ID: 12937
  Gene Symbol: POLG2
  Gene Name: polymerase (DNA directed), gamma 2, accessory subunit
  ENSP ID: ENSP00000464389
ICQRRHFLSGSKQQLSRDSLLSGCHPGFGPLGVELRKNLAAEWWTSVVVFREQVFPVDALHHKPGPLLPGDSAFRCLGTLC

SEQ ID NO: 64967 - protein, 575 aa, Homo sapiens
  Payload ID: 12938
  Gene Symbol: POLL
  Gene Name: polymerase (DNA directed), lambda
  Uniprot ID: Q9UGP5
  ENSP ID: ENSP00000299206
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 64968 - protein, 298 aa, Homo sapiens
  Payload ID: 12938
  Gene Symbol: POLL
  Gene Name: polymerase (DNA directed), lambda
  ENSP ID: ENSP00000343102
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 64969 - protein, 575 aa, Homo sapiens; identical to SEQ ID NO: 64967
  Payload ID: 12938
  Gene Symbol: POLL
  Gene Name: polymerase (DNA directed), lambda
  Uniprot ID: Q9UGP5
  ENSP ID: ENSP00000359181

SEQ ID NO: 64970 - protein, 248 aa, Homo sapiens
  Payload ID: 12938
  Gene Symbol: POLL
  Gene Name: polymerase (DNA directed), lambda
  ENSP ID: ENSP00000359187
MEALCVCSLMPLHWSWILTASHLAAFFQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 64971 - protein, 575 aa, Homo sapiens; identical to SEQ ID NO: 64967
  Payload ID: 12938
  Gene Symbol: POLL
  Gene Name: polymerase (DNA directed), lambda
  Uniprot ID: Q9UGP5
  ENSP ID: ENSP00000359188

SEQ ID NO: 64972 - protein, 487 aa, Homo sapiens
  Payload ID: 12938
  Gene Symbol: POLL
  Gene Name: polymerase (DNA directed), lambda
  ENSP ID: ENSP00000359191
MDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 64973 - protein, 151 aa, Homo sapiens
  Payload ID: 12938
  Gene Symbol: POLL
  Gene Name: polymerase (DNA directed), lambda
  ENSP ID: ENSP00000390093
MDYERALRLLRLPQLPPGAQLVKSAWLSLCLQERRLVDVAGFSIFIPSSPSLMMKPVMGKKPRLVQLIWKPSSVATTPPPLREIVSLAQPLLSWISGSVHSPQARRRPITTSISQRSWKFWPKPTVFRETSGGPWAMPRPSMPSRASISLS

SEQ ID NO: 64974 - protein, 268 aa, Homo sapiens
  Payload ID: 12938
  Gene Symbol: POLL
  Gene Name: polymerase (DNA directed), lambda
  ENSP ID: ENSP00000400517
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYS

SEQ ID NO: 64975 - protein, 470 aa, Homo sapiens
  Payload ID: 12938
  Gene Symbol: POLL
  Gene Name: polymerase (DNA directed), lambda
  ENSP ID: ENSP00000400676
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEAVPSVGPGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPT

SEQ ID NO: 64976 - protein, 218 aa, Homo sapiens
  Payload ID: 12938
  Gene Symbol: POLL
  Gene Name: polymerase (DNA directed), lambda
  ENSP ID: ENSP00000406791
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVP

SEQ ID NO: 64977 - protein, 334 aa, Homo sapiens
  Payload ID: 12938
  Gene Symbol: POLL
  Gene Name: polymerase (DNA directed), lambda
  ENSP ID: ENSP00000411678
MDPRGILKAFPKRQKIHADASSKPSCASALRCLCPESDIGADSACPGPAEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLR

SEQ ID NO: 64978 - protein, 188 aa, Homo sapiens
  Payload ID: 12938
  Gene Symbol: POLL
  Gene Name: polymerase (DNA directed), lambda
  ENSP ID: ENSP00000414293
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNT

SEQ ID NO: 64979 - protein, 300 aa, Homo sapiens
  Payload ID: 12938
  Gene Symbol: POLL
  Gene Name: polymerase (DNA directed), lambda
  Uniprot ID: Q9UGP5
  ENSP ID: ENSP00000485885
MLMHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 64980 - protein, 494 aa, Homo sapiens
  Payload ID: 12939
  Gene Symbol: POLM
  Gene Name: polymerase (DNA directed), mu
  Uniprot ID: Q9NP87
  ENSP ID: ENSP00000242248
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 64981 - protein, 457 aa, Homo sapiens
  Payload ID: 12939
  Gene Symbol: POLM
  Gene Name: polymerase (DNA directed), mu
  Uniprot ID: Q9NP87
  ENSP ID: ENSP00000335141
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAAPPGPEHPSPAVRCRCPAAGGGGSCGAGPAWGHRHADRRLPQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 64982 - protein, 508 aa, Homo sapiens
  Payload ID: 12939
  Gene Symbol: POLM
  Gene Name: polymerase (DNA directed), mu
  Uniprot ID: Q9NP87
  ENSP ID: ENSP00000379174
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERAPAPPGPEHPSPAVRCRCPAAGGGGSCGAGPAWGHRHADRRLPQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQGSSSGKTPRSRKSCFCCRRHFSKRLQRKTSSDTWALSTFLQSRETPEPACVPHFHSGNWAAPNLATECLQADMLPPDPHLHPSPPRPGSSGGQLCLQDQLSPCWCAAGCDEVGALSASLITV

SEQ ID NO: 64983 - protein, 155 aa, Homo sapiens
  Payload ID: 12939
  Gene Symbol: POLM
  Gene Name: polymerase (DNA directed), mu
  ENSP ID: ENSP00000388230
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEELLEHGVCEEVERVRRSERYQTMKGSSTTRT

SEQ ID NO: 64984 - protein, 159 aa, Homo sapiens
  Payload ID: 12939
  Gene Symbol: POLM
  Gene Name: polymerase (DNA directed), mu
  ENSP ID: ENSP00000390899
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEEALEILAEAAGFEGSEGRLLTFCRAASVLKALPSP

SEQ ID NO: 64985 - protein, 233 aa, Homo sapiens
  Payload ID: 12939
  Gene Symbol: POLM
  Gene Name: polymerase (DNA directed), mu
  ENSP ID: ENSP00000395043
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRR

SEQ ID NO: 64986 - protein, 242 aa, Homo sapiens
  Payload ID: 12939
  Gene Symbol: POLM
  Gene Name: polymerase (DNA directed), mu
  ENSP ID: ENSP00000396571
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSESSSPRSSGSV

SEQ ID NO: 64987 - protein, 168 aa, Homo sapiens
  Payload ID: 12939
  Gene Symbol: POLM
  Gene Name: polymerase (DNA directed), mu
  ENSP ID: ENSP00000397135
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEAFLPHQVDDTATPSGMTHGLAGACPLDAIRLPASDRWLGQGRGL

SEQ ID NO: 64988 - protein, 165 aa, Homo sapiens
  Payload ID: 12939
  Gene Symbol: POLM
  Gene Name: polymerase (DNA directed), mu
  ENSP ID: ENSP00000399244
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSGPSLQEAL

SEQ ID NO: 64989 - protein, 135 aa, Homo sapiens
  Payload ID: 12939
  Gene Symbol: POLM
  Gene Name: polymerase (DNA directed), mu
  ENSP ID: ENSP00000406750
  MOD_RES (1)..(1): Any amino acid
XWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKVRRAGLGPTPGMSCPGNDNTVHTMHGEANRGS

SEQ ID NO: 64990 - protein, 270 aa, Homo sapiens
  Payload ID: 12939
  Gene Symbol: POLM
  Gene Name: polymerase (DNA directed), mu
  ENSP ID: ENSP00000414025
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKVRRAGLGPTPGMSCPGNDNTVHTMHGEANRGS

SEQ ID NO: 64991 - protein, 2590 aa, Homo sapiens
  Payload ID: 12940
  Gene Symbol: POLQ
  Gene Name: polymerase (DNA directed), theta
  Uniprot ID: O75417
  ENSP ID: ENSP00000264233
MNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 64992 - protein, 2725 aa, Homo sapiens
  Payload ID: 12940
  Gene Symbol: POLQ
  Gene Name: polymerase (DNA directed), theta
  ENSP ID: ENSP00000481120
MNGHRFTFRTRSLLPLQKGQHRCITKLLAHNDPWGIFRAPSSRRSYSVSGVCQPAIPNSSLHIPHNACWLKWKLCSEIALPYHHILGERRKLCSIRNFEDWREDVRSCCQARVLPRGRTLGLWLALIGREEFAMNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 64993 - protein, 466 aa, Homo sapiens
  Payload ID: 12941
  Gene Symbol: POLD3
  Gene Name: polymerase (DNA-directed), delta 3, accessory subunit
  Uniprot ID: Q15054
  ENSP ID: ENSP00000263681
MADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 64994 - protein, 111 aa, Homo sapiens
  Payload ID: 12941
  Gene Symbol: POLD3
  Gene Name: polymerase (DNA-directed), delta 3, accessory subunit
  ENSP ID: ENSP00000431239
MLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSS

SEQ ID NO: 64995 - protein, 169 aa, Homo sapiens
  Payload ID: 12941
  Gene Symbol: POLD3
  Gene Name: polymerase (DNA-directed), delta 3, accessory subunit
  ENSP ID: ENSP00000432233
MLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETN

SEQ ID NO: 64996 - protein, 427 aa, Homo sapiens
  Payload ID: 12941
  Gene Symbol: POLD3
  Gene Name: polymerase (DNA-directed), delta 3, accessory subunit
  Uniprot ID: Q15054
  ENSP ID: ENSP00000432951
MLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 64997 - protein, 149 aa, Homo sapiens
  Payload ID: 12941
  Gene Symbol: POLD3
  Gene Name: polymerase (DNA-directed), delta 3, accessory subunit
  ENSP ID: ENSP00000432969
  MOD_RES (1)..(1): Any amino acid
XPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVVLDMQSHSLDILEHYVEMPIQRLER

SEQ ID NO: 64998 - protein, 360 aa, Homo sapiens
  Payload ID: 12941
  Gene Symbol: POLD3
  Gene Name: polymerase (DNA-directed), delta 3, accessory subunit
  Uniprot ID: Q15054
  ENSP ID: ENSP00000436018
MLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 64999 - protein, 89 aa, Homo sapiens
  Payload ID: 12941
  Gene Symbol: POLD3
  Gene Name: polymerase (DNA-directed), delta 3, accessory subunit
  ENSP ID: ENSP00000436781
  MOD_RES (1)..(1): Any amino acid
XNAFEDACEMEVVFWGLIAERIVTEKVYESESCTDSEEELNMKTSSVHRPPAMTVKKEPREERKGPKKGTAALGKANRQVSITGFFQRK

SEQ ID NO: 65000 - protein, 138 aa, Homo sapiens
  Payload ID: 12941
  Gene Symbol: POLD3
  Gene Name: polymerase (DNA-directed), delta 3, accessory subunit
  ENSP ID: ENSP00000437231
MLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGH

SEQ ID NO: 65001 - protein, 107 aa, Homo sapiens
  Payload ID: 12942
  Gene Symbol: POLD4
  Gene Name: polymerase (DNA-directed), delta 4, accessory subunit
  Uniprot ID: Q9HCU8
  ENSP ID: ENSP00000311368
MGRKRLITDSYPVVKRREGPAGHSKGELAPELGEEPQPRDEEEAELELLRQFDLAWQYGPCTGITRLQRWCRAKQMGLEPPPEVWQVLKTHPGDPRFQCSLWHLYPL

SEQ ID NO: 65002 - protein, 32 aa, Homo sapiens
  Payload ID: 12942
  Gene Symbol: POLD4
  Gene Name: polymerase (DNA-directed), delta 4, accessory subunit
  ENSP ID: ENSP00000433408
MGLEPPPEVWQVLKTHPGDPRFQCSLWHLYPL

SEQ ID NO: 65003 - protein, 32 aa, Homo sapiens; identical to SEQ ID NO: 65002
  Payload ID: 12942
  Gene Symbol: POLD4
  Gene Name: polymerase (DNA-directed), delta 4, accessory subunit
  ENSP ID: ENSP00000436361

SEQ ID NO: 65004 - protein, 79 aa, Homo sapiens
  Payload ID: 12942
  Gene Symbol: POLD4
  Gene Name: polymerase (DNA-directed), delta 4, accessory subunit
  Uniprot ID: Q9HCU8
  ENSP ID: ENSP00000444780
MGRKRLITDSYPVVKRREGPAGHSKGELAPELGEEPQPRDEEEAELELLRQFDLAWQYGPCTVSGISIPYEAPRKTSCP

SEQ ID NO: 65005 - protein, 32 aa, Homo sapiens; identical to SEQ ID NO: 65002
  Payload ID: 12942
  Gene Symbol: POLD4
  Gene Name: polymerase (DNA-directed), delta 4, accessory subunit
  ENSP ID: ENSP00000479678

SEQ ID NO: 65006 - protein, 32 aa, Homo sapiens; identical to SEQ ID NO: 65002
  Payload ID: 12942
  Gene Symbol: POLD4
  Gene Name: polymerase (DNA-directed), delta 4, accessory subunit
  ENSP ID: ENSP00000481251

SEQ ID NO: 65007 - protein, 368 aa, Homo sapiens
  Payload ID: 12943
  Gene Symbol: POLDIP2
  Gene Name: polymerase (DNA-directed), delta interacting protein 2
  Uniprot ID: Q9Y2S7
  ENSP ID: ENSP00000475924
MAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 65008 - protein, 350 aa, Homo sapiens
  Payload ID: 12943
  Gene Symbol: POLDIP2
  Gene Name: polymerase (DNA-directed), delta interacting protein 2
  ENSP ID: ENSP00000477665
MAACTARRALAVGSRWWSRSLTGARWPRPLCAAAGAGAFSPASTTTTRRHLSSRNRPEGKVLETVGVFEVPKQNGKYETGQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 65009 - protein, 421 aa, Homo sapiens
  Payload ID: 12944
  Gene Symbol: POLDIP3
  Gene Name: polymerase (DNA-directed), delta interacting protein 3
  Uniprot ID: Q9BY77
  ENSP ID: ENSP00000252115
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 65010 - protein, 392 aa, Homo sapiens
  Payload ID: 12944
  Gene Symbol: POLDIP3
  Gene Name: polymerase (DNA-directed), delta interacting protein 3
  Uniprot ID: Q9BY77
  ENSP ID: ENSP00000252116
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 65011 - protein, 185 aa, Homo sapiens
  Payload ID: 12944
  Gene Symbol: POLDIP3
  Gene Name: polymerase (DNA-directed), delta interacting protein 3
  ENSP ID: ENSP00000343060
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVGLRAVPLLCLVSGGAWVGSRSQASCPLPSGSRPH

SEQ ID NO: 65012 - protein, 438 aa, Homo sapiens
  Payload ID: 12944
  Gene Symbol: POLDIP3
  Gene Name: polymerase (DNA-directed), delta interacting protein 3
  ENSP ID: ENSP00000397927
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQRMHVDPVGWILTTECFQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 65013 - protein, 189 aa, Homo sapiens
  Payload ID: 12944
  Gene Symbol: POLDIP3
  Gene Name: polymerase (DNA-directed), delta interacting protein 3
  ENSP ID: ENSP00000408046
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQNLYDLDEDDDGIASVPTKQMKFAASGGFLHHMGPGLSSN

SEQ ID NO: 65014 - protein, 281 aa, Homo sapiens
  Payload ID: 12944
  Gene Symbol: POLDIP3
  Gene Name: polymerase (DNA-directed), delta interacting protein 3
  ENSP ID: ENSP00000415234
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPIGRHQDDCE

SEQ ID NO: 65015 - protein, 229 aa, Homo sapiens [sequence omitted]

SEQ ID NO: 65016 - protein, 117 aa, Homo sapiens
  Payload ID: 12945
  Gene Symbol: POLE4
  Gene Name: polymerase (DNA-directed), epsilon 4, accessory subunit
  Uniprot ID: Q9NR33
  ENSP ID: ENSP00000420176
MAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEGTLD

SEQ ID NO: 65017 - protein, 1720 aa, Homo sapiens
  Payload ID: 12946
  Gene Symbol: POLR1A
  Gene Name: polymerase (RNA) I polypeptide A, 194kDa
  Uniprot ID: O95602
  ENSP ID: ENSP00000263857
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 65018 - protein, 1659 aa, Homo sapiens
  Payload ID: 12946
  Gene Symbol: POLR1A
  Gene Name: polymerase (RNA) I polypeptide A, 194kDa
  ENSP ID: ENSP00000386300
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 65019 - protein, 42 aa, Homo sapiens
  Payload ID: 12946
  Gene Symbol: POLR1A
  Gene Name: polymerase (RNA) I polypeptide A, 194kDa
  ENSP ID: ENSP00000386423
MLISKNMPWRRLQGISFGMYSAEELNFWKKIPIPLPLKFGRN

SEQ ID NO: 65020 - protein, 42 aa, Homo sapiens; identical to SEQ ID NO: 65019
  Payload ID: 12946
  Gene Symbol: POLR1A
  Gene Name: polymerase (RNA) I polypeptide A, 194kDa
  ENSP ID: ENSP00000397321

SEQ ID NO: 65021 - protein, 1135 aa, Homo sapiens
  Payload ID: 12947
  Gene Symbol: POLR1B
  Gene Name: polymerase (RNA) I polypeptide B, 128kDa
  Uniprot ID: Q9H9Y6
  ENSP ID: ENSP00000263331
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 65022 - protein, 73 aa, Homo sapiens
  Payload ID: 12947
  Gene Symbol: POLR1B
  Gene Name: polymerase (RNA) I polypeptide B, 128kDa
  ENSP ID: ENSP00000334589
MDPGSRWRNLPSGPSLKHLTDPSYGIPREQQKAALQELTRAHVESFNYAVHEGLGLAVQRRGLPMWPSLVSNS

SEQ ID NO: 65023 - protein, 952 aa, Homo sapiens
  Payload ID: 12947
  Gene Symbol: POLR1B
  Gene Name: polymerase (RNA) I polypeptide B, 128kDa
  Uniprot ID: Q9H9Y6
  ENSP ID: ENSP00000387143
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKGSLPLMELPTDHTVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 65024 - protein, 128 aa, Homo sapiens
  Payload ID: 12947
  Gene Symbol: POLR1B
  Gene Name: polymerase (RNA) I polypeptide B, 128kDa
  ENSP ID: ENSP00000388577
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKG

SEQ ID NO: 65025 - protein, 105 aa, Homo sapiens
  Payload ID: 12947
  Gene Symbol: POLR1B
  Gene Name: polymerase (RNA) I polypeptide B, 128kDa
  ENSP ID: ENSP00000390274
MDPGSRWRNLPSGPSLKHLTDPSYGIPREQQKAALQELTRAHVESFNYAVHEGLGLAVQGSLPLMELPTDHTVSATLSCWTVSWLAGWIRILLQASQILFVILRC

SEQ ID NO: 65026 - protein, 92 aa, Homo sapiens
  Payload ID: 12947
  Gene Symbol: POLR1B
  Gene Name: polymerase (RNA) I polypeptide B, 128kDa
  ENSP ID: ENSP00000390973
MDPGSRWRNLPSGPSLKHLTDPSYGIPREQQKAALQELTRAHVESFNYAVHEGLGLAVQSTYSSKRDHLQRGQCLSSRMPGPKEYLPWEVDS

SEQ ID NO: 65027 - protein, 307 aa, Homo sapiens
  Payload ID: 12947
  Gene Symbol: POLR1B
  Gene Name: polymerase (RNA) I polypeptide B, 128kDa
  ENSP ID: ENSP00000394408
PGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPS

SEQ ID NO: 65028 - protein, 65 aa, Homo sapiens
  Payload ID: 12947
  Gene Symbol: POLR1B
  Gene Name: polymerase (RNA) I polypeptide B, 128kDa
  ENSP ID: ENSP00000403094
MDPGSRWRNLPSGPSLKHLTDPSYGIPREQQKAALQELTRAHVESFNYAVHEGLGLAVQEFQCTV

SEQ ID NO: 65029 - protein, 1079 aa, Homo sapiens
  Payload ID: 12947
  Gene Symbol: POLR1B
  Gene Name: polymerase (RNA) I polypeptide B, 128kDa
  Uniprot ID: Q9H9Y6
  ENSP ID: ENSP00000405358
MDPGSRWRNLPSGPSLKHLTDPSYGIPREQQKAALQELTRAHVESFNYAVHEGLGLAVQADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 65030 - protein, 114 aa, Homo sapiens
  Payload ID: 12947
  Gene Symbol: POLR1B
  Gene Name: polymerase (RNA) I polypeptide B, 128kDa
  ENSP ID: ENSP00000415754
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKL

SEQ ID NO: 65031 - protein, 924 aa, Homo sapiens
  Payload ID: 12947
  Gene Symbol: POLR1B
  Gene Name: polymerase (RNA) I polypeptide B, 128kDa
  Uniprot ID: Q9H9Y6
  ENSP ID: ENSP00000437914
MHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 65032 - protein, 1173 aa, Homo sapiens
  Payload ID: 12947
  Gene Symbol: POLR1B
  Gene Name: polymerase (RNA) I polypeptide B, 128kDa
  Uniprot ID: Q9H9Y6
  ENSP ID: ENSP00000444136
MRAKEAAETGLRPLLPACTERLASGVYRETGVRCAGGHMDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 65033 - protein, 342 aa, Homo sapiens
  Payload ID: 12948
  Gene Symbol: POLR1C
  Gene Name: polymerase (RNA) I polypeptide C, 30kDa
  Uniprot ID: O15160
  ENSP ID: ENSP00000307212
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYICKKDLLAAVAHTCNPSTLGGQGEWITGSRERDHPG

SEQ ID NO: 65034 - protein, 296 aa, Homo sapiens
  Payload ID: 12948
  Gene Symbol: POLR1C
  Gene Name: polymerase (RNA) I polypeptide C, 30kDa
  ENSP ID: ENSP00000361419
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKKVARVANPRLDTFSREIFRNEKLKKVVRLARVRDHYIFSVESTGVLPPDVLVSEAIKVLMGKCRRFLDELDAVQMD

SEQ ID NO: 65035 - protein, 346 aa, Homo sapiens
  Payload ID: 12948
  Gene Symbol: POLR1C
  Gene Name: polymerase (RNA) I polypeptide C, 30kDa
  Uniprot ID: O15160
  ENSP ID: ENSP00000361465
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYIFSVESTGVLPPDVLVSEAIKVLMGKCRRFLDELDAVQMD

SEQ ID NO: 65036 - protein, 124 aa, Homo sapiens
  Payload ID: 12948
  Gene Symbol: POLR1C
  Gene Name: polymerase (RNA) I polypeptide C, 30kDa
  ENSP ID: ENSP00000395401
MDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLG

SEQ ID NO: 65037 - protein, 140 aa, Homo sapiens
  Payload ID: 12948
  Gene Symbol: POLR1C
  Gene Name: polymerase (RNA) I polypeptide C, 30kDa
  ENSP ID: ENSP00000409536
  MOD_RES (1)..(1): Any amino acid
XAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQVYTRHMTWIPLGN

SEQ ID NO: 65038 - protein, 133 aa, Homo sapiens
  Payload ID: 12949
  Gene Symbol: POLR1D
  Gene Name: polymerase (RNA) I polypeptide D, 16kDa
  Uniprot ID: Q9Y2S0
  ENSP ID: ENSP00000302478
MEEDQELERKISGLKTSMAEGERKTALEMVQAAGTDRHCVTFVLHEEDHTLGNSLRYMIMKNPEVEFCGYTTTHPSESKINLRIQTRGTLPAVEPFQRGLNELMNVCQHVLDKFEASIKDYKDQKASRNESTF

SEQ ID NO: 65039 - protein, 116 aa, Homo sapiens
  Payload ID: 12949
  Gene Symbol: POLR1D
  Gene Name: polymerase (RNA) I polypeptide D, 16kDa
  ENSP ID: ENSP00000382603
MAEGERKTALEMVQAAGTDRHCVTFVLHEEDHTLGNSLRYMIMKNPEVEFCGYTTTHPSESKINLRIQTRGTLPAVEPFQRGLNELMNVCQHVLDKFEASIKDYKDQKASRNESTF

SEQ ID NO: 65040 - protein, 122 aa, Homo sapiens
  Payload ID: 12949
  Gene Symbol: POLR1D
  Gene Name: polymerase (RNA) I polypeptide D, 16kDa
  Uniprot ID: Q9Y2S0
  ENSP ID: ENSP00000382604
MEEDQELERKAIEELLKEAKRGKTRAETMGPMGWMKCPLASTNKRFLINTIKNTLPSHKEQDHEQKEGDKEPAKSQAQKEENPKKHRSHPYKHSFRARGSASYSPPRKRSSQDKYEKRSNRR

SEQ ID NO: 65041 - protein, 94 aa, Homo sapiens
  Payload ID: 12949
  Gene Symbol: POLR1D
  Gene Name: polymerase (RNA) I polypeptide D, 16kDa
  ENSP ID: ENSP00000478213
MGPMGWMKCPLASTNKRFLINTIKNTLPSHKEQDHEQKEGDKEPAKSQAQKEENPKKHRSHPYKHSFRARGSASYSPPRKRSSQDKYEKRSNRR

SEQ ID NO: 65042 - protein, 42 aa, Homo sapiens
  Payload ID: 12949
  Gene Symbol: POLR1D
  Gene Name: polymerase (RNA) I polypeptide D, 16kDa
  ENSP ID: ENSP00000483656
MEEDQELERKAIEELLKEAKRGKTRAETMGPMGCLLQGQDTN

SEQ ID NO: 65043 - protein, 2 aa, Homo sapiens
  Payload ID: 12949
  Gene Symbol: POLR1D
  Gene Name: polymerase (RNA) I polypeptide D, 16kDa
  ENSP ID: ENSP00000486327
MG

SEQ ID NO: 65044 - protein, 33 aa, Homo sapiens
  Payload ID: 12949
  Gene Symbol: POLR1D
  Gene Name: polymerase (RNA) I polypeptide D, 16kDa
  ENSP ID: ENSP00000486928
MEEDQELERKAIEELLKEAKRGKTRAETMGPMG

SEQ ID NO: 65045 - protein, 42 aa, Homo sapiens; identical to SEQ ID NO: 65042
  Payload ID: 12949
  Gene Symbol: POLR1D
  Gene Name: polymerase (RNA) I polypeptide D, 16kDa
  ENSP ID: ENSP00000487057

SEQ ID NO: 65046 - protein, 481 aa, Homo sapiens
  Payload ID: 12950
  Gene Symbol: POLR1E
  Gene Name: polymerase (RNA) I polypeptide E, 53kDa
  Uniprot ID: Q9GZS1
  ENSP ID: ENSP00000367023
MYQASAVSLLPRDIPSCHSPSPGFSHLPTSSSQLAPDLLQFPLGQDPSFLAIPILTLPPSDSLVPPYIVWYIVWPSALISFLGCTLTVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 65047 - protein, 419 aa, Homo sapiens
  Payload ID: 12950
  Gene Symbol: POLR1E
  Gene Name: polymerase (RNA) I polypeptide E, 53kDa
  Uniprot ID: Q9GZS1
  ENSP ID: ENSP00000367029
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 65048 - protein, 141 aa, Homo sapiens
  Payload ID: 12950
  Gene Symbol: POLR1E
  Gene Name: polymerase (RNA) I polypeptide E, 53kDa
  ENSP ID: ENSP00000399887
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSGLSPRKQNYFLERAKDLFSNPVSATTW

SEQ ID NO: 65049 - protein, 566 aa, Homo sapiens
  Payload ID: 12951
  Gene Symbol: POLR2A
  Gene Name: polymerase (RNA) II (DNA directed) polypeptide A, 220kDa
  Uniprot ID: P24928
  ENSP ID: ENSP00000461879
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERVCGPNGNLA

SEQ ID NO: 65050 - protein, 1980 aa, Homo sapiens
  Payload ID: 12951
  Gene Symbol: POLR2A
  Gene Name: polymerase (RNA) II (DNA directed) polypeptide A, 220kDa
  ENSP ID: ENSP00000480158
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPTSTPQPVLLTVPAPQSIPQPLPSTHLPVPNIHPPLPSTRLPVPPIHPPPQNTPQHLLLIPQPLQSTPQPLPSTHLLAPLTRPLPPSTRPPAPPTRPPPPKAQPTLPLPLVTRPPAPPTVSQARLSARMTVTRRTEGTWGAAAG

SEQ ID NO: 65051 - protein, 1970 aa, Homo sapiens
  Payload ID: 12951
  Gene Symbol: POLR2A
  Gene Name: polymerase (RNA) II (DNA directed) polypeptide A, 220kDa
  ENSP ID: ENSP00000483957
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 65052 - protein, 1174 aa, Homo sapiens
  Payload ID: 12952
  Gene Symbol: POLR2B
  Gene Name: polymerase (RNA) II (DNA directed) polypeptide B, 140kDa
  Uniprot ID: P30876
  ENSP ID: ENSP00000312735
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 65053 - protein, 1174 aa, Homo sapiens; identical to SEQ ID NO: 65052
  Payload ID: 12952
  Gene Symbol: POLR2B
  Gene Name: polymerase (RNA) II (DNA directed) polypeptide B, 140kDa
  Uniprot ID: P30876
  ENSP ID: ENSP00000370625

SEQ ID NO: 65054 - protein, 1099 aa, Homo sapiens
  Payload ID: 12952
  Gene Symbol: POLR2B
  Gene Name: polymerase (RNA) II (DNA directed) polypeptide B, 140kDa
  ENSP ID: ENSP00000391096
MLDCNQPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 65055 - protein, 1167 aa, Homo sapiens
  Payload ID: 12952
  Gene Symbol: POLR2B
  Gene Name: polymerase (RNA) II (DNA directed) polypeptide B, 140kDa
  ENSP ID: ENSP00000391452
MQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 65056 - protein, 76 aa, Homo sapiens
  Payload ID: 12952
  Gene Symbol: POLR2B
  Gene Name: polymerase (RNA) II (DNA directed) polypeptide B, 140kDa
  ENSP ID: ENSP00000407728
MQYDEDDDEITPDLWQEACWIVISSYFDEKGLVRQQLDSFDEFIQMSVQRIVEDAPPIDLQAEAQHASGEVEEPVR

SEQ ID NO: 65057 - protein, 64 aa, Homo sapiens
  Payload ID: 12952
  Gene Symbol: POLR2B
  Gene Name: polymerase (RNA) II (DNA directed) polypeptide B, 140kDa
  ENSP ID: ENSP00000408638
MYDADEDMQYDEDDDEITPDLWQEACWIVISSYFDEKGLVRQQLDSFDEFIQMSVQRIVEDAPP

SEQ ID NO: 65058 - protein, 275 aa, Homo sapiens
  Payload ID: 12953
  Gene Symbol: POLR2C
  Gene Name: polymerase (RNA) II (DNA directed) polypeptide C, 33kDa
  Uniprot ID: P19387
  ENSP ID: ENSP00000219252
MPYANQPTVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 65059 - protein, 46 aa, Homo sapiens
  Payload ID: 12953
  Gene Symbol: POLR2C
  Gene Name: polymerase (RNA) II (DNA directed) polypeptide C, 33kDa
  ENSP ID: ENSP00000456367
MPYANQPTVRITELTDENVKFIIENTDLAVANSIRRVFIAEVPIIG

SEQ ID NO: 65060 - protein, 142 aa, Homo sapiens
  Payload ID: 12954
  Gene Symbol: POLR2D
  Gene Name: polymerase (RNA) II (DNA directed) polypeptide D
  Uniprot ID: O15514
  ENSP ID: ENSP00000272645
MAAGGSDPRAGDVEEDASQLIFPKEFETAETLLNSEVHMLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 65061 - protein, 104 aa, Homo sapiens
  Payload ID: 12954
  Gene Symbol: POLR2D
  Gene Name: polymerase (RNA) II (DNA directed) polypeptide D
  ENSP ID: ENSP00000387117
MLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 65062 - protein, 110 aa, Homo sapiens
  Payload ID: 12954
  Gene Symbol: POLR2D
  Gene Name: polymerase (RNA) II (DNA directed) polypeptide D
  ENSP ID: ENSP00000387323
MAAGGSDPRAGDVEEDASQLIFPKEFETAETLLNSEVHMLLEHRKQQNESAEDEQELSEVFMKTLNYTARFSRFKNRETIASVRSLEGRFEDEELQQILDDIQTKRSFQY

SEQ ID NO: 65063 - protein, 204 aa, Homo sapiens
  Payload ID: 12955
  Gene Symbol: POLR2E
  Gene Name: polymerase (RNA) II (DNA directed) polypeptide E, 25kDa
  ENSP ID: ENSP00000215587
MDDEEETYRLWKIRKTIMQLCHDRGYLVTQDELDQTLEEFKAQSGDKPSEGRPRRTDLTVLVAHNDDPTDQMFVFFPEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQPLLSVSAGGEDHPAQ

SEQ ID NO: 65064 - protein, 210 aa, Homo sapiens
  Payload ID: 12955
  Gene Symbol: POLR2E
  Gene Name: polymerase (RNA) II (DNA directed) polypeptide E, 25kDa
  Uniprot ID: P19388
  ENSP ID: ENSP00000464739
MDDEEETYRLWKIRKTIMQLCHDRGYLVTQDELDQTLEEFKAQSGDKPSEGRPRRTDLTVLVAHNDDPTDQMFVFFPEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQVVKIIRPSETAGRYITYRLVQ

SEQ ID NO: 65065 - protein, 68 aa, Homo sapiens
  Payload ID: 12955
  Gene Symbol: POLR2E
  Gene Name: polymerase (RNA) II (DNA directed) polypeptide E, 25kDa
  ENSP ID: ENSP00000465066
MDDEEETYRLWKIRKTIMQVSSGSRGSSGEATRAPAEEPVASTHPHSPGAQHLSLCPVWEENSPPLPC

SEQ ID NO: 65066 - protein, 51 aa, Homo sapiens
  Payload ID: 12955
  Gene Symbol: POLR2E
  Gene Name: polymerase (RNA) II (DNA directed) polypeptide E, 25kDa
  ENSP ID: ENSP00000467905
MDDEEETYRLWKIRKTIMQRSPRWASRPSRCTASACRRRTSHGLSSWCSRA

SEQ ID NO: 65067 - protein, 210 aa, Homo sapiens; identical to SEQ ID NO: 65064
  Payload ID: 12955
  Gene Symbol: POLR2E
  Gene Name: polymerase (RNA) II (DNA directed) polypeptide E, 25kDa
  Uniprot ID: P19388
  ENSP ID: ENSP00000478303

SEQ ID NO: 65068 - protein, 83 aa, Homo sapiens
  Payload ID: 12955
  Gene Symbol: POLR2E
  Gene Name: polymerase (RNA) II (DNA directed) polypeptide E, 25kDa
  ENSP ID: ENSP00000479560
PASASQSARITEEPKVGIKTIKVYCQRMQEENITRALIVVQQGMTPSAKQSLVDMAPKYILEQFLQQELLINITEHESLSTSS

SEQ ID NO: 65069 - protein, 184 aa, Homo sapiens
  Payload ID: 12955
  Gene Symbol: POLR2E
  Gene Name: polymerase (RNA) II (DNA directed) polypeptide E, 25kDa
  ENSP ID: ENSP00000479813
MDDEEETYRLWKIRKTIMQLCHDRGYLVTQDELDQTLEEFKAQSGDKPSEGRPRRTDLTVLVAHNDDPTDQMFVFFPEEPKVGIKTIKVYCQRMQEENITRALIVVQQGMTPSAKQLVPEHVVMTKEEVTELLARYKLRENQLPRIQAGDPVARYFGIKRGQVVKIIRPSETAGRYITYRLVHP

SEQ ID NO: 65070 - protein, 134 aa, Homo sapiens
  Payload ID: 12955
  Gene Symbol: POLR2E
  Gene Name: polymerase (RNA) II (DNA directed) polypeptide E, 25kDa
  ENSP ID: ENSP00000480562
  MOD_RES (1)..(1): Any amino acid
XEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQVVKIIRPSETAGRYITYRLVQ

SEQ ID NO: 65071 - protein, 210 aa, Homo sapiens; identical to SEQ ID NO: 65064
  Payload ID: 12955
  Gene Symbol: POLR2E
  Gene Name: polymerase (RNA) II (DNA directed) polypeptide E, 25kDa
  Uniprot ID: P19388
  ENSP ID: ENSP00000485021

SEQ ID NO: 65072 - protein, 145 aa, Homo sapiens
  Payload ID: 12956
  Gene Symbol: POLR2F
  Gene Name: polymerase (RNA) II (DNA directed) polypeptide F
  ENSP ID: ENSP00000332130
  MOD_RES (1)..(1): Any amino acid
XWMDRGTRDEHLPSCPGCPAVASNTRCCPPAACLPGISLSRAGTVSSPSCLLHGMDSGALNRCSEINDSESRSQPENVLLRGPWNLPLVHLGFSLLNKTDSAACSSEKVLVEDSPQVPLPGSPTAPEGWPSDAWVAGLLDPSMDK

SEQ ID NO: 65073 - protein, 126 aa, Homo sapiens
  Payload ID: 12956
  Gene Symbol: POLR2F
  Gene Name: polymerase (RNA) II (DNA directed) polypeptide F
  ENSP ID: ENSP00000384112
MSDNEDNFDGDDFDDVEEDEGLDDLENAEEEGQENVEILPSGERPQANQKRITTPYMTKYERARVLGTRALQIAMCAPVMVELEGETDPLLIAMKELKLLWGLEYTVLRPSYALAHSLGSFSISSR

SEQ ID NO: 65074 - protein, 158 aa, Homo sapiens
  Payload ID: 12956
  Gene Symbol: POLR2F
  Gene Name: polymerase (RNA) II (DNA directed) polypeptide F
  ENSP ID: ENSP00000385725
MSDNEDNFDGDDFDDVEEDEGLDDLENAEEEGQENVEILPSGERPQANQKRITTPYMTKYERARVLGTRALQIAMCAPVMVELEGETDPLLIAMKELNARSASEPPGEEPPWMDRGTRDEHLPSCPGCPAVASNTRCCPPAACLPGISLSRRRRLREE

SEQ ID NO: 65075 - protein, 93 aa, Homo sapiens
  Payload ID: 12956
  Gene Symbol: POLR2F
  Gene Name: polymerase (RNA) II (DNA directed) polypeptide F
  ENSP ID: ENSP00000389307
  MOD_RES (1)..(1): Any amino acid
XTEGRGTSICRRVPAALQSPPTPAAARPLPACLASLSPGLGPSLLPPVFYMGWTQERSTDALKSMTLNLEVNRRMCSSEGPGIFPSCTWVSVC

SEQ ID NO: 65076 - protein, 127 aa, Homo sapiens
  Payload ID: 12956
  Gene Symbol: POLR2F
  Gene Name: polymerase (RNA) II (DNA directed) polypeptide F
  Uniprot ID: P61218
  ENSP ID: ENSP00000403852
MSDNEDNFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 65077 - protein, 111 aa, Homo sapiens
  Payload ID: 12956
  Gene Symbol: POLR2F
  Gene Name: polymerase (RNA) II (DNA directed) polypeptide F
  ENSP ID: ENSP00000406826
MSDNEDNFDGDDFDDVEEDEGLDDLENAEEEGQENVEILPSGERPQANQKRITTPYMTKYERARVLGTRALQIAMCAPVMVELEGETDPLLIAMKELNYFQKAFEEAPVQG

SEQ ID NO: 65078 - protein, 74 aa, Homo sapiens
  Payload ID: 12956
  Gene Symbol: POLR2F
  Gene Name: polymerase (RNA) II (DNA directed) polypeptide F
  ENSP ID: ENSP00000475257
MSDNEDNFDGDDFDDVEEDEGLDDLENAEEVSIQPQAPTSAAQAAKSSDRMCAPVMVELEGETDPLLIAMKELK

SEQ ID NO: 65079 - protein, 76 aa, Homo sapiens
  Payload ID: 12956
  Gene Symbol: POLR2F
  Gene Name: polymerase (RNA) II (DNA directed) polypeptide F
  ENSP ID: ENSP00000475342
MSDNEDNFDGDDFDDVEEDEGLDDLENAEEVSIQPQAPTSAAQAAKSSDRKARRMSRSSPLGSDRRPTRSESPHHT

SEQ ID NO: 65080 - protein, 112 aa, Homo sapiens
  Payload ID: 12956
  Gene Symbol: POLR2F
  Gene Name: polymerase (RNA) II (DNA directed) polypeptide F
  ENSP ID: ENSP00000475343
MVSISCLVIRPPRPPKVLGLQEGQENVEILPSGERPQANQKRITTPYMTKYERARVLGTRALQIAMCAPVMVELEGETDPLLIAMKELKARKIPIIIRRYLPDGSYEDWGVD

SEQ ID NO: 65081 - protein, 122 aa, Homo sapiens
  Payload ID: 12956
  Gene Symbol: POLR2F
  Gene Name: polymerase (RNA) II (DNA directed) polypeptide F
  ENSP ID: ENSP00000475707
MSFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 65082 - protein, 76 aa, Homo sapiens; identical to SEQ ID NO: 65079
  Payload ID: 12956
  Gene Symbol: POLR2F
  Gene Name: polymerase (RNA) II (DNA directed) polypeptide F
  ENSP ID: ENSP00000476132

SEQ ID NO: 65083 - protein, 98 aa, Homo sapiens
  Payload ID: 12956
  Gene Symbol: POLR2F
  Gene Name: polymerase (RNA) II (DNA directed) polypeptide F
  ENSP ID: ENSP00000476187
MSDNEDNFDGDDFDDVEEDEGLDDLENAEEEGQENVEILPSGERPQANQKRITTPYMTKYERARVLGTRALQIAMCAPVMVELEGETDPLLIAMKELK

SEQ ID NO: 65084 - protein, 172 aa, Homo sapiens
  Payload ID: 12957
  Gene Symbol: POLR2G
  Gene Name: polymerase (RNA) II (DNA directed) polypeptide G
  Uniprot ID: P62487
  ENSP ID: ENSP00000301788
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 65085 - protein, 41 aa, Homo sapiens
  Payload ID: 12957
  Gene Symbol: POLR2G
  Gene Name: polymerase (RNA) II (DNA directed) polypeptide G
  ENSP ID: ENSP00000431624
MFYHISLEHEILLHPRYFGPNLLNTVKQKLFTEVEGTCTGK

SEQ ID NO: 65086 - protein, 13 aa, Homo sapiens
  Payload ID: 12957
  Gene Symbol: POLR2G
  Gene Name: polymerase (RNA) II (DNA directed) polypeptide G
  ENSP ID: ENSP00000432198
MSCFISRHSIPSE

SEQ ID NO: 65087 - protein, 64 aa, Homo sapiens
  Payload ID: 12957
  Gene Symbol: POLR2G
  Gene Name: polymerase (RNA) II (DNA directed) polypeptide G
  ENSP ID: ENSP00000433529
MFYHISLEHEILLHPRYFGPNLLNTVKQKLFTEVEGTCTGKIKTVWGRPENLHFKKMILRHPED

SEQ ID NO: 65088 - protein, 41 aa, Homo sapiens; identical to SEQ ID NO: 65085
  Payload ID: 12957
  Gene Symbol: POLR2G
  Gene Name: polymerase (RNA) II (DNA directed) polypeptide G
  ENSP ID: ENSP00000433877

SEQ ID NO: 65089 - protein, 60 aa, Homo sapiens
  Payload ID: 12957
  Gene Symbol: POLR2G
  Gene Name: polymerase (RNA) II (DNA directed) polypeptide G
  ENSP ID: ENSP00000435669
ISLEHEILLHPRYFGPNLLNTVKQKLFTEVEGTCTGKIKTVWGRPENLHFKKMILRHPED

SEQ ID NO: 65090 - protein, 150 aa, Homo sapiens
  Payload ID: 12958
  Gene Symbol: POLR2H
  Gene Name: polymerase (RNA) II (DNA directed) polypeptide H
  Uniprot ID: P52434
  ENSP ID: ENSP00000392913
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 65091 - protein, 86 aa, Homo sapiens
  Payload ID: 12958
  Gene Symbol: POLR2H
  Gene Name: polymerase (RNA) II (DNA directed) polypeptide H
  Uniprot ID: P52434
  ENSP ID: ENSP00000393773
MDLILDVNIQIYPVDLGDKFRLVIASTLYEDGTLDDGEYNPTDDRPSSSAYVSYGGLLMRLQGDANNLHGFEVDSRVYLLMKKLAF

SEQ ID NO: 65092 - protein, 114 aa, Homo sapiens
  Payload ID: 12958
  Gene Symbol: POLR2H
  Gene Name: polymerase (RNA) II (DNA directed) polypeptide H
  Uniprot ID: P52434
  ENSP ID: ENSP00000398622
MDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 65093 - protein, 114 aa, Homo sapiens; identical to SEQ ID NO: 65092
  Payload ID: 12958
  Gene Symbol: POLR2H
  Gene Name: polymerase (RNA) II (DNA directed) polypeptide H
  Uniprot ID: P52434
  ENSP ID: ENSP00000399882

SEQ ID NO: 65094 - protein, 11 aa, Homo sapiens
  Payload ID: 12958
  Gene Symbol: POLR2H
  Gene Name: polymerase (RNA) II (DNA directed) polypeptide H
  ENSP ID: ENSP00000403728
MAGILFEDIFD

SEQ ID NO: 65095 - protein, 148 aa, Homo sapiens
  Payload ID: 12958
  Gene Symbol: POLR2H
  Gene Name: polymerase (RNA) II (DNA directed) polypeptide H
  ENSP ID: ENSP00000409065
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKL

SEQ ID NO: 65096 - protein, 122 aa, Homo sapiens
  Payload ID: 12958
  Gene Symbol: POLR2H
  Gene Name: polymerase (RNA) II (DNA directed) polypeptide H
  Uniprot ID: P52434
  ENSP ID: ENSP00000411883
MAGILFEDIFDVKDIDPEGKKFDRVSRLHCESESFKMDLILDVNIQIYPVDLGDKFRLVIASTLYEDGTLDDGEYNPTDDRPSSSAYVSYGGLLMRLQGDANNLHGFEVDSRVYLLMKKLAF

SEQ ID NO: 65097 - protein, 175 aa, Homo sapiens
  Payload ID: 12958
  Gene Symbol: POLR2H
  Gene Name: polymerase (RNA) II (DNA directed) polypeptide H
  Uniprot ID: P52434
  ENSP ID: ENSP00000415536
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLLRLRAAEWQCSRITGWGLLFQLCVRVLWGPAHEAAGGCQQPAWIRGGLQSLSPDEEASLLNLA

SEQ ID NO: 65098 - protein, 125 aa, Homo sapiens
  Payload ID: 12959
  Gene Symbol: POLR2I
  Gene Name: polymerase (RNA) II (DNA directed) polypeptide I, 14.5kDa
  Uniprot ID: P36954
  ENSP ID: ENSP00000221859
MEPDGTYEPGFVGIRFCQECNNMLYPKEDKENRILLYACRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 65099 - protein, 46 aa, Homo sapiens
  Payload ID: 12959
  Gene Symbol: POLR2I
  Gene Name: polymerase (RNA) II (DNA directed) polypeptide I, 14.5kDa
  ENSP ID: ENSP00000465455
MEPDGTYEPGFVGIRFCQECAGTVITSRRPTTAASMSTRSRTKWTN

SEQ ID NO: 65100 - protein, 88 aa, Homo sapiens
  Payload ID: 12959
  Gene Symbol: POLR2I
  Gene Name: polymerase (RNA) II (DNA directed) polypeptide I, 14.5kDa
  ENSP ID: ENSP00000465755
MEPDGTYEPGFVGIRFCQECNNMLYPKEDKENRILLYACRNCDYQQEADNSCIYVNKITHEVDELTQIIADVSQDPTLPRTEDHPCQK

SEQ ID NO: 65101 - protein, 57 aa, Homo sapiens
  Payload ID: 12959
  Gene Symbol: POLR2I
  Gene Name: polymerase (RNA) II (DNA directed) polypeptide I, 14.5kDa
  ENSP ID: ENSP00000467134
MEPDGTYEPGFVVTTCCTPRKTRRTAFCSTRAGTVITSRRPTTAASMSTRSRTKWTN

SEQ ID NO: 65102 - protein, 117 aa, Homo sapiens
  Payload ID: 12960
  Gene Symbol: POLR2J
  Gene Name: polymerase (RNA) II (DNA directed) polypeptide J, 13.3kDa
  Uniprot ID: P52435
  ENSP ID: ENSP00000292614
MNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 65103 - protein, 158 aa, Homo sapiens [sequence omitted]

SEQ ID NO: 65104 - protein, 115 aa, Homo sapiens; identical to SEQ ID NO: 25154
  Payload ID: 12961
  Gene Symbol: POLR2J2
  Gene Name: polymerase (RNA) II (DNA directed) polypeptide J2
  Uniprot ID: Q9GZM3
  ENSP ID: ENSP00000330898

SEQ ID NO: 65105 - protein, 158 aa, Homo sapiens
  Payload ID: 12961
  Gene Symbol: POLR2J2
  Gene Name: polymerase (RNA) II (DNA directed) polypeptide J2
  ENSP ID: ENSP00000351218
MNAPPAFESFLLFEGEKITINKDTKVPKACLFTINKEDHTLGNIIKSQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 65106 - protein, 115 aa, Homo sapiens
  Payload ID: 12962
  Gene Symbol: POLR2J3
  Gene Name: polymerase (RNA) II (DNA directed) polypeptide J3
  Uniprot ID: Q9H1A7
  ENSP ID: ENSP00000368645
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 65107 - protein, 128 aa, Homo sapiens
  Payload ID: 12962
  Gene Symbol: POLR2J3
  Gene Name: polymerase (RNA) II (DNA directed) polypeptide J3
  ENSP ID: ENSP00000419082
MNAPPAFESFLLFEGEKQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 65108 - protein, 158 aa, Homo sapiens
  Payload ID: 12962
  Gene Symbol: POLR2J3
  Gene Name: polymerase (RNA) II (DNA directed) polypeptide J3
  ENSP ID: ENSP00000419145
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 65109 - protein, 116 aa, Homo sapiens
  Payload ID: 12962
  Gene Symbol: POLR2J3
  Gene Name: polymerase (RNA) II (DNA directed) polypeptide J3
  ENSP ID: ENSP00000419146
MNAPPAFESFLLFEGEKITINKDTKVPNACLFTINKEDHTLGNIIKSRACFPFAFCRDCQFPEASPATLPVQPAELCPRAHQLCAPALKRHLGGEAHPVHLHAGAASRPVQQPQHL

SEQ ID NO: 65110 - protein, 274 aa, Homo sapiens
  Payload ID: 12962
  Gene Symbol: POLR2J3
  Gene Name: polymerase (RNA) II (DNA directed) polypeptide J3
  ENSP ID: ENSP00000421085
MNAPPAFESFLLFEGEKITINKDTKVPNACLFTINKEDHTLGNIIKSRACFPFAFCRDCQFPEASPATLPVQPAELLAWKSPCATGKDINKHQEVSKSTRSHRHHVDIHLPVFPGKILLNCAALAKRAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTR

SEQ ID NO: 65111 - protein, 73 aa, Homo sapiens
  Payload ID: 12962
  Gene Symbol: POLR2J3
  Gene Name: polymerase (RNA) II (DNA directed) polypeptide J3
  ENSP ID: ENSP00000421950
MNAPPAFESFLLFEGEKITINKDTKVPNACLFTINKEDHTLGNIIKSLECNGTILLTATSASRVQVILLLQPS

SEQ ID NO: 65112 - protein, 76 aa, Homo sapiens
  Payload ID: 12962
  Gene Symbol: POLR2J3
  Gene Name: polymerase (RNA) II (DNA directed) polypeptide J3
  ENSP ID: ENSP00000422109
MNAPPAFESFLLFEGEKITINKDTKVPNACLFTINKEDHTLGNIIKSRACFPFAFCRDCQFPEASPATLPVQPAEL

SEQ ID NO: 65113 - protein, 115 aa, Homo sapiens; identical to SEQ ID NO: 65106
  Payload ID: 12962
  Gene Symbol: POLR2J3
  Gene Name: polymerase (RNA) II (DNA directed) polypeptide J3
  ENSP ID: ENSP00000425877

SEQ ID NO: 65114 - protein, 76 aa, Homo sapiens; identical to SEQ ID NO: 65112
  Payload ID: 12962
  Gene Symbol: POLR2J3
  Gene Name: polymerase (RNA) II (DNA directed) polypeptide J3
  ENSP ID: ENSP00000426619

SEQ ID NO: 65115 - protein, 115 aa, Homo sapiens; identical to SEQ ID NO: 65106
  Payload ID: 12962
  Gene Symbol: POLR2J3
  Gene Name: polymerase (RNA) II (DNA directed) polypeptide J3
  ENSP ID: ENSP00000477228

SEQ ID NO: 65116 - protein, 158 aa, Homo sapiens; identical to SEQ ID NO: 65108
  Payload ID: 12962
  Gene Symbol: POLR2J3
  Gene Name: polymerase (RNA) II (DNA directed) polypeptide J3
  ENSP ID: ENSP00000482932

SEQ ID NO: 65117 - protein, 115 aa, Homo sapiens; identical to SEQ ID NO: 65106
  Payload ID: 12962
  Gene Symbol: POLR2J3
  Gene Name: polymerase (RNA) II (DNA directed) polypeptide J3
  ENSP ID: ENSP00000483328

SEQ ID NO: 65118 - protein, 58 aa, Homo sapiens
  Payload ID: 12963
  Gene Symbol: POLR2K
  Gene Name: polymerase (RNA) II (DNA directed) polypeptide K, 7.0kDa
  Uniprot ID: P53803
  ENSP ID: ENSP00000342889
MDTQKDVQPPKQQPMIYICGECHTENEIKSRDPIRCRECGYRIMYKKRTKRLVVFDAR

SEQ ID NO: 65119 - protein, 67 aa, Homo sapiens
  Payload ID: 12963
  Gene Symbol: POLR2K
  Gene Name: polymerase (RNA) II (DNA directed) polypeptide K, 7.0kDa
  ENSP ID: ENSP00000430106
MDTQKDVQPPKQQPMIYICGECHTENEIKSRDPIRCRECGYRIMYKKRTKRCILLTMLSKYELGGNE

SEQ ID NO: 65120 - protein, 67 aa, Homo sapiens
  Payload ID: 12964
  Gene Symbol: POLR2L
  Gene Name: polymerase (RNA) II (DNA directed) polypeptide L, 7.6kDa
  Uniprot ID: P62875
  ENSP ID: ENSP00000324124
MIIPVRCFTCGKIVGNKWEAYLGLLQAEYTEGDALDALGLKRYCCRRMLLAHVDLIEKLLNYAPLEK

SEQ ID NO: 65121 - protein, 67 aa, Homo sapiens; identical to SEQ ID NO: 65120
  Payload ID: 12964
  Gene Symbol: POLR2L
  Gene Name: polymerase (RNA) II (DNA directed) polypeptide L, 7.6kDa
  Uniprot ID: P62875
  ENSP ID: ENSP00000432807

SEQ ID NO: 65122 - protein, 368 aa, Homo sapiens
  Payload ID: 12965
  Gene Symbol: POLR2M
  Gene Name: polymerase (RNA) II (DNA directed) polypeptide M
  Uniprot ID: P0CAP2
  ENSP ID: ENSP00000299638
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 65123 - protein, 211 aa, Homo sapiens
  Payload ID: 12965
  Gene Symbol: POLR2M
  Gene Name: polymerase (RNA) II (DNA directed) polypeptide M
  Uniprot ID: P0CAP2
  ENSP ID: ENSP00000369930
MCSLPRGFEPQAPEDLAQRSLVELREMLKRQERLLRNELQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 65124 - protein, 363 aa, Homo sapiens
  Payload ID: 12965
  Gene Symbol: POLR2M
  Gene Name: polymerase (RNA) II (DNA directed) polypeptide M
  Uniprot ID: P0CAP2
  ENSP ID: ENSP00000432615
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEERPFYSPQYRSSMNLLSLAAAAKDTRGSKSGKMGSLALLTKL

SEQ ID NO: 65125 - protein, 38 aa, Homo sapiens
  Payload ID: 12965
  Gene Symbol: POLR2M
  Gene Name: polymerase (RNA) II (DNA directed) polypeptide M
  ENSP ID: ENSP00000433988
MCSLPRGFEPQAPEDLAQRSLVELREMLKRQERLLRNE

SEQ ID NO: 65126 - protein, 38 aa, Homo sapiens; identical to SEQ ID NO: 65125
  Payload ID: 12965
  Gene Symbol: POLR2M
  Gene Name: polymerase (RNA) II (DNA directed) polypeptide M
  ENSP ID: ENSP00000437015

SEQ ID NO: 65127 - protein, 1390 aa, Homo sapiens
  Payload ID: 12966
  Gene Symbol: POLR3A
  Gene Name: polymerase (RNA) III (DNA directed) polypeptide A, 155kDa
  Uniprot ID: O14802
  ENSP ID: ENSP00000361446
MVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 65128 - protein, 199 aa, Homo sapiens
  Payload ID: 12966
  Gene Symbol: POLR3A
  Gene Name: polymerase (RNA) III (DNA directed) polypeptide A, 155kDa
  ENSP ID: ENSP00000473389
  MOD_RES (1)..(1): Any amino acid
XINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKMLQSRTVS

SEQ ID NO: 65129 - protein, 162 aa, Homo sapiens [sequence omitted]

SEQ ID NO: 65130 - protein, 1133 aa, Homo sapiens
  Payload ID: 12967
  Gene Symbol: POLR3B
  Gene Name: polymerase (RNA) III (DNA directed) polypeptide B
  Uniprot ID: Q9NW08
  ENSP ID: ENSP00000228347
MDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 65131 - protein, 1075 aa, Homo sapiens
  Payload ID: 12967
  Gene Symbol: POLR3B
  Gene Name: polymerase (RNA) III (DNA directed) polypeptide B
  Uniprot ID: Q9NW08
  ENSP ID: ENSP00000445721
MKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 65132 - protein, 169 aa, Homo sapiens
  Payload ID: 12967
  Gene Symbol: POLR3B
  Gene Name: polymerase (RNA) III (DNA directed) polypeptide B
  ENSP ID: ENSP00000448398
MGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQI

SEQ ID NO: 65133 - protein, 534 aa, Homo sapiens
  Payload ID: 12968
  Gene Symbol: POLR3C
  Gene Name: polymerase (RNA) III (DNA directed) polypeptide C (62kD)
  Uniprot ID: Q9BUI4
  ENSP ID: ENSP00000334564
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 65134 - protein, 411 aa, Homo sapiens
  Payload ID: 12968
  Gene Symbol: POLR3C
  Gene Name: polymerase (RNA) III (DNA directed) polypeptide C (62kD)
  ENSP ID: ENSP00000358300
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQVGCQ

SEQ ID NO: 65135 - protein, 398 aa, Homo sapiens
  Payload ID: 12969
  Gene Symbol: POLR3D
  Gene Name: polymerase (RNA) III (DNA directed) polypeptide D, 44kDa
  Uniprot ID: P05423
  ENSP ID: ENSP00000303088
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 65136 - protein, 398 aa, Homo sapiens; identical to SEQ ID NO: 65135
  Payload ID: 12969
  Gene Symbol: POLR3D
  Gene Name: polymerase (RNA) III (DNA directed) polypeptide D, 44kDa
  Uniprot ID: P05423
  ENSP ID: ENSP00000380904

SEQ ID NO: 65137 - protein, 207 aa, Homo sapiens
  Payload ID: 12969
  Gene Symbol: POLR3D
  Gene Name: polymerase (RNA) III (DNA directed) polypeptide D, 44kDa
  ENSP ID: ENSP00000429677
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKE

SEQ ID NO: 65138 - protein, 123 aa, Homo sapiens
  Payload ID: 12969
  Gene Symbol: POLR3D
  Gene Name: polymerase (RNA) III (DNA directed) polypeptide D, 44kDa
  ENSP ID: ENSP00000429821
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKVPR

SEQ ID NO: 65139 - protein, 708 aa, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENSP ID: ENSP00000299853
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 65140 - protein, 666 aa, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENSP ID: ENSP00000352140
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQDCCVSYGGMWYLKGTVQS

SEQ ID NO: 65141 - protein, 672 aa, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENSP ID: ENSP00000399254
MANEEDDPVVQEIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 65142 - protein, 63 aa, Homo sapiens
  Payload ID: 12970
  Gene Symbol: POLR3E
  Gene Name: polymerase (RNA) III (DNA directed) polypeptide E (80kD)
  ENSP ID: ENSP00000454225
  MOD_RES (1)..(1): Any amino acid
XYCRSKGEQIALNVDGACADETSTYSSKLMDKQTFCSSQTTSNTSRYAAALYRQAAAQLLLPG

SEQ ID NO: 65143 - protein, 139 aa, Homo sapiens
  Payload ID: 12970
  Gene Symbol: POLR3E
  Gene Name: polymerase (RNA) III (DNA directed) polypeptide E (80kD)
  ENSP ID: ENSP00000454507
MELTFYCRRQTTPEQIDQIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGIL

SEQ ID NO: 65144 - protein, 90 aa, Homo sapiens
  Payload ID: 12970
  Gene Symbol: POLR3E
  Gene Name: polymerase (RNA) III (DNA directed) polypeptide E (80kD)
  ENSP ID: ENSP00000454875
MMLMPPSQEEEKDKPVAPSNVLSMAQLRTLPLADQIKILMKNVKVMPFANLMSLLGPSIDSVAVLRGIQKVAMLVQGNWVVKSDILYPKD

SEQ ID NO: 65145 - protein, 99 aa, Homo sapiens
  Payload ID: 12970
  Gene Symbol: POLR3E
  Gene Name: polymerase (RNA) III (DNA directed) polypeptide E (80kD)
  ENSP ID: ENSP00000456454
MTYDDIPHLSAKIKPKQQKVELEMAIDTLNPNYCRSKGEQIALNVDGACADETSTYSSKLMDKQTFCSSQTTSNTSRYAAALYRQGELHLTPLHGILQL

SEQ ID NO: 65146 - protein, 92 aa, Homo sapiens
  Payload ID: 12970
  Gene Symbol: POLR3E
  Gene Name: polymerase (RNA) III (DNA directed) polypeptide E (80kD)
  ENSP ID: ENSP00000456526
MANEEDDPVVQEIDVYLAKSLAEKLYLFQYPVRPASMTYDDIPHLSAKIKPKQQKQRGADCAERGRGLRRRDQHVFLEADGQADLLLFPDHQ

SEQ ID NO: 65147 - protein, 110 aa, Homo sapiens
  Payload ID: 12970
  Gene Symbol: POLR3E
  Gene Name: polymerase (RNA) III (DNA directed) polypeptide E (80kD)
  ENSP ID: ENSP00000456718
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSN

SEQ ID NO: 65148 - protein, 62 aa, Homo sapiens
  Payload ID: 12970
  Gene Symbol: POLR3E
  Gene Name: polymerase (RNA) III (DNA directed) polypeptide E (80kD)
  ENSP ID: ENSP00000456771
MANEEDDPVVQEIDVYLAKSLAEKLYLFQMGKLKEHRRGRSVQQLKLGLWGQTGLRSNSITP

SEQ ID NO: 65149 - protein, 687 aa, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENSP ID: ENSP00000456967
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQSRLTQECGEDLSKQEVDKVLKDCCVSYGGMWYLKGTVQS

SEQ ID NO: 65150 - protein, 672 aa, Homo sapiens
  Payload ID: 12970
  Gene Symbol: POLR3E
  Gene Name: polymerase (RNA) III (DNA directed) polypeptide E (80kD)
  ENSP ID: ENSP00000484648
MTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 65151 - protein, 316 aa, Homo sapiens
  Payload ID: 12971
  Gene Symbol: POLR3F
  Gene Name: polymerase (RNA) III (DNA directed) polypeptide F, 39 kDa
  Uniprot ID: Q9H1D9
  ENSP ID: ENSP00000366828
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKAETARESKQNPMIQRNSSFASSHEVWKYICELGISKVELSMEDIETILNTLIYDGKVEMTIIAAKEGTVGSVDGHMKLYRAVNPIIPPTGLVRAPCGLCPVFDDCHEGGEISPSNCIYMTEWLEF

SEQ ID NO: 65152 - protein, 223 aa, Homo sapiens
  Payload ID: 12972
  Gene Symbol: POLR3G
  Gene Name: polymerase (RNA) III (DNA directed) polypeptide G (32kD)
  Uniprot ID: O15318
  ENSP ID: ENSP00000382058
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADSDDNMDEATY

SEQ ID NO: 65153 - protein, 223 aa, Homo sapiens; identical to SEQ ID NO: 65152
  Payload ID: 12972
  Gene Symbol: POLR3G
  Gene Name: polymerase (RNA) III (DNA directed) polypeptide G (32kD)
  Uniprot ID: O15318
  ENSP ID: ENSP00000421637

SEQ ID NO: 65154 - protein, 127 aa, Homo sapiens
  Payload ID: 12972
  Gene Symbol: POLR3G
  Gene Name: polymerase (RNA) III (DNA directed) polypeptide G (32kD)
  ENSP ID: ENSP00000422164
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKGTLTNIIVI

SEQ ID NO: 65155 - protein, 220 aa, Homo sapiens
  Payload ID: 12972
  Gene Symbol: POLR3G
  Gene Name: polymerase (RNA) III (DNA directed) polypeptide G (32kD)
  ENSP ID: ENSP00000422892
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADSDDNMDE

SEQ ID NO: 65156 - protein, 39 aa, Homo sapiens
  Payload ID: 12972
  Gene Symbol: POLR3G
  Gene Name: polymerase (RNA) III (DNA directed) polypeptide G (32kD)
  ENSP ID: ENSP00000424970
MAGNKGRGRAAYTFNIEAVGFSKGEKLPDVVLKPPPLFP

SEQ ID NO: 65157 - protein, 100 aa, Homo sapiens
  Payload ID: 12972
  Gene Symbol: POLR3G
  Gene Name: polymerase (RNA) III (DNA directed) polypeptide G (32kD)
  ENSP ID: ENSP00000425617
MAGNKGRGRAAYTFNIEAVGFSKGEKLPDVVLKPPPLFPDTDYKPVPLKTGEGEEYMLALKQELRETMKRMPYFIETPEERQETGVLLFCSHWSHIPGFK

SEQ ID NO: 65158 - protein, 92 aa, Homo sapiens
  Payload ID: 12972
  Gene Symbol: POLR3G
  Gene Name: polymerase (RNA) III (DNA directed) polypeptide G (32kD)
  ENSP ID: ENSP00000427412
MAGNKGRGRAAYTFNIEAVGFSKGEKLPDVVLKPPPLFPDTDYKPVPLKTGEGEEYMLALKQELRETMKRMPYFIETPEERQDIERYSKRYM

SEQ ID NO: 65159 - protein, 233 aa, Homo sapiens
  Payload ID: 12972
  Gene Symbol: POLR3G
  Gene Name: polymerase (RNA) III (DNA directed) polypeptide G (32kD)
  ENSP ID: ENSP00000478166
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADVMTTWMRQPIRHEIFQKIFL

SEQ ID NO: 65160 - protein, 195 aa, Homo sapiens
  Payload ID: 12973
  Gene Symbol: POLR3GL
  Gene Name: polymerase (RNA) III (DNA directed) polypeptide G (32kD)-like
  ENSP ID: ENSP00000358319
MASRGGGRGRGRGQLTFNVEAVGIGKGDALPPPTLQPSPLFPPLEFRPVPLPSGEEGEYVLALKQELRGAMRQLPYFIRPAVPKRDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 65161 - protein, 218 aa, Homo sapiens
  Payload ID: 12973
  Gene Symbol: POLR3GL
  Gene Name: polymerase (RNA) III (DNA directed) polypeptide G (32kD)-like
  Uniprot ID: Q9BT43
  ENSP ID: ENSP00000358320
MASRGGGRGRGRGQLTFNVEAVGIGKGDALPPPTLQPSPLFPPLEFRPVPLPSGEEGEYVLALKQELRGAMRQLPYFIRPAVPKRDVERYSDKYQMSGPIDNAIDWNPDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 65162 - protein, 175 aa, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENSP ID: ENSP00000337627
MFVLVEMVDTVRIPPWQFERKLNDSIAEELNKKLANKVVYNVGLCICLFDITKLEDAYVFPGDGASHTKVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 65163 - protein, 204 aa, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENSP ID: ENSP00000347345
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 65164 - protein, 204 aa, Homo sapiens; identical to SEQ ID NO: 65163
  Payload ID: 12974
  Gene Symbol: POLR3H
  Gene Name: polymerase (RNA) III (DNA directed) polypeptide H (22.9kD)
  Uniprot ID: Q9Y535
  ENSP ID: ENSP00000379761

SEQ ID NO: 65165 - protein, 204 aa, Homo sapiens; identical to SEQ ID NO: 65163
  Payload ID: 12974
  Gene Symbol: POLR3H
  Gene Name: polymerase (RNA) III (DNA directed) polypeptide H (22.9kD)
  Uniprot ID: Q9Y535
  ENSP ID: ENSP00000385315

SEQ ID NO: 65166 - protein, 123 aa, Homo sapiens
  Payload ID: 12974
  Gene Symbol: POLR3H
  Gene Name: polymerase (RNA) III (DNA directed) polypeptide H (22.9kD)
  ENSP ID: ENSP00000395674
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHGNSGPDASDKTWEHCGGRSLSRLLR

SEQ ID NO: 65167 - protein, 70 aa, Homo sapiens
  Payload ID: 12974
  Gene Symbol: POLR3H
  Gene Name: polymerase (RNA) III (DNA directed) polypeptide H (22.9kD)
  ENSP ID: ENSP00000408083
MFVLVEMVDTVRIPPWQFERKLNDSIAEELNKKLANKVVYNVGLCICLFDITKLEDAYVFPGDGASHTKG

SEQ ID NO: 65168 - protein, 160 aa, Homo sapiens
  Payload ID: 12974
  Gene Symbol: POLR3H
  Gene Name: polymerase (RNA) III (DNA directed) polypeptide H (22.9kD)
  ENSP ID: ENSP00000415053
MFVLVEMVDTVRIPPWQFERKLNDSIAEELNKKLANKVLGPRLAGRPWRGRASAAHWPQARPRSCQALAVGKQLNVSELFFTVKGDIEGDQKKMGLKKGVVTGSVRFHNSKLLCNCRSCTTWDSAFVCLISPNWRMPMYSLGMAHHTPKSIFAAWCFIHS

SEQ ID NO: 65169 - protein, 108 aa, Homo sapiens
  Payload ID: 12975
  Gene Symbol: POLR3K
  Gene Name: polymerase (RNA) III (DNA directed) polypeptide K, 12.3 kDa
  Uniprot ID: Q9Y2Y1
  ENSP ID: ENSP00000293860
MLLFCPGCGNGLIVEEGQRCHRFACNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 65170 - protein, 1230 aa, Homo sapiens
  Payload ID: 12976
  Gene Symbol: POLRMT
  Gene Name: polymerase (RNA) mitochondrial (DNA directed)
  Uniprot ID: O00411
  ENSP ID: ENSP00000465759
MSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEELGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 65171 - protein, 347 aa, Homo sapiens
  Payload ID: 12976
  Gene Symbol: POLRMT
  Gene Name: polymerase (RNA) mitochondrial (DNA directed)
  ENSP ID: ENSP00000466504
VLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSK

SEQ ID NO: 65172 - protein, 127 aa, Homo sapiens
  Payload ID: 12976
  Gene Symbol: POLRMT
  Gene Name: polymerase (RNA) mitochondrial (DNA directed)
  ENSP ID: ENSP00000468658
  MOD_RES (1)..(1): Any amino acid
XPGLQGQANRRWNSEHHLHPQRRHQPPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQA

SEQ ID NO: 65173 - protein, 56 aa, Homo sapiens
  Payload ID: 12976
  Gene Symbol: POLRMT
  Gene Name: polymerase (RNA) mitochondrial (DNA directed)
  ENSP ID: ENSP00000473524
MSALCWGRGAAGLKRALRPCGRPGLPGKEGNTKGDGQAARGPRRGLLPARPGPLAL

SEQ ID NO: 65174 - protein, 390 aa, Homo sapiens
  Payload ID: 12977
  Gene Symbol: PTRF
  Gene Name: polymerase I and transcript release factor
  Uniprot ID: Q6NZI2
  ENSP ID: ENSP00000349541
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 65175 - protein, 764 aa, Homo sapiens
  Payload ID: 12978
  Gene Symbol: PIGR
  Gene Name: polymeric immunoglobulin receptor
  Uniprot ID: P01833
  ENSP ID: ENSP00000348888
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 65176 - protein, 521 aa, Homo sapiens
  Payload ID: 12979
  Gene Symbol: PNKP
  Gene Name: polynucleotide kinase 3'-phosphatase
  Uniprot ID: Q96T60
  ENSP ID: ENSP00000323511
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 65177 - protein, 51 aa, Homo sapiens
  Payload ID: 12979
  Gene Symbol: PNKP
  Gene Name: polynucleotide kinase 3'-phosphatase
  ENSP ID: ENSP00000468896
MGEVEAPGRLWLESPPGGAPPIFLPSDGQALVLGRGPLTQVTDRKCSRTQA

SEQ ID NO: 65178 - protein, 490 aa, Homo sapiens
  Payload ID: 12979
  Gene Symbol: PNKP
  Gene Name: polynucleotide kinase 3'-phosphatase
  ENSP ID: ENSP00000469826
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 65179 - protein, 247 aa, Homo sapiens
  Payload ID: 12979
  Gene Symbol: PNKP
  Gene Name: polynucleotide kinase 3'-phosphatase
  ENSP ID: ENSP00000469848
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPF

SEQ ID NO: 65180 - protein, 51 aa, Homo sapiens; identical to SEQ ID NO: 65177
  Payload ID: 12979
  Gene Symbol: PNKP
  Gene Name: polynucleotide kinase 3'-phosphatase
  ENSP ID: ENSP00000470346

SEQ ID NO: 65181 - protein, 176 aa, Homo sapiens
  Payload ID: 12979
  Gene Symbol: PNKP
  Gene Name: polynucleotide kinase 3'-phosphatase
  ENSP ID: ENSP00000470887
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTL

SEQ ID NO: 65182 - protein, 56 aa, Homo sapiens
  Payload ID: 12979
  Gene Symbol: PNKP
  Gene Name: polynucleotide kinase 3'-phosphatase
  ENSP ID: ENSP00000471097
ARYVQCARAAGVPCRCFLFTATLEQARHNNRFREMTDSSHIPVSDMVMYGYRYCWG

SEQ ID NO: 65183 - protein, 521 aa, Homo sapiens; identical to SEQ ID NO: 65176
  Payload ID: 12979
  Gene Symbol: PNKP
  Gene Name: polynucleotide kinase 3'-phosphatase
  Uniprot ID: Q96T60
  ENSP ID: ENSP00000472300

SEQ ID NO: 65184 - protein, 455 aa, Homo sapiens
  Payload ID: 12979
  Gene Symbol: PNKP
  Gene Name: polynucleotide kinase 3'-phosphatase
  ENSP ID: ENSP00000473137
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRVRPVCPSRGRPLPLLPLHRHSGAGAPQQPVSRDDGLLSYPRVRHGHVWLQEAVRGPNAG

SEQ ID NO: 65185 - protein, 174 aa, Homo sapiens
  Payload ID: 12979
  Gene Symbol: PNKP
  Gene Name: polynucleotide kinase 3'-phosphatase
  ENSP ID: ENSP00000486037
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKDLVPRDSP

SEQ ID NO: 65186 - protein, 256 aa, Homo sapiens
  Payload ID: 12979
  Gene Symbol: PNKP
  Gene Name: polynucleotide kinase 3'-phosphatase
  ENSP ID: ENSP00000486500
  MOD_RES (1)..(1): Any amino acid
XGLEGSLGVGDTLYLVNGLHPLTLRWEETRTPESQPDTPPGTPLVSQDEKRDAELPKKRMRKSNPGWENLEKLLVFTAAGVKPQGKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFL

SEQ ID NO: 65187 - protein, 485 aa, Homo sapiens
  Payload ID: 12979
  Gene Symbol: PNKP
  Gene Name: polynucleotide kinase 3'-phosphatase
  ENSP ID: ENSP00000486707
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 65188 - protein, 87 aa, Homo sapiens
  Payload ID: 12979
  Gene Symbol: PNKP
  Gene Name: polynucleotide kinase 3'-phosphatase
  ENSP ID: ENSP00000486898
DGTPISIGDSIFVGDAAGRPANWAPGRKKKDFSCADRLFALNLGLPFATPEEFFLKWPAAGFELPAFDPPGSPPFSRSTSCRPDMST

SEQ ID NO: 65189 - protein, 559 aa, Homo sapiens
  Payload ID: 12980
  Gene Symbol: GALNT1
  Gene Name: polypeptide N-acetylgalactosaminyltransferase 1
  Uniprot ID: Q10472
  ENSP ID: ENSP00000269195
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 65190 - protein, 387 aa, Homo sapiens
  Payload ID: 12980
  Gene Symbol: GALNT1
  Gene Name: polypeptide N-acetylgalactosaminyltransferase 1
  ENSP ID: ENSP00000465341
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPG

SEQ ID NO: 65191 - protein, 50 aa, Homo sapiens
  Payload ID: 12980
  Gene Symbol: GALNT1
  Gene Name: polypeptide N-acetylgalactosaminyltransferase 1
  ENSP ID: ENSP00000465452
MRKFAYCKVVLATSLIWVLLDMFLLLYFSECNKCDEKKERGLPAGDAQVN

SEQ ID NO: 65192 - protein, 105 aa, Homo sapiens
  Payload ID: 12980
  Gene Symbol: GALNT1
  Gene Name: polypeptide N-acetylgalactosaminyltransferase 1
  Uniprot ID: Q10472
  ENSP ID: ENSP00000465699
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEG

SEQ ID NO: 65193 - protein, 105 aa, Homo sapiens; identical to SEQ ID NO: 65192
  Payload ID: 12980
  Gene Symbol: GALNT1
  Gene Name: polypeptide N-acetylgalactosaminyltransferase 1
  Uniprot ID: Q10472
  ENSP ID: ENSP00000466411

SEQ ID NO: 65194 - protein, 603 aa, Homo sapiens
  Payload ID: 12981
  Gene Symbol: GALNT10
  Gene Name: polypeptide N-acetylgalactosaminyltransferase 10
  Uniprot ID: Q86SR1
  ENSP ID: ENSP00000297107
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 65195 - protein, 541 aa, Homo sapiens
  Payload ID: 12981
  Gene Symbol: GALNT10
  Gene Name: polypeptide N-acetylgalactosaminyltransferase 10
  Uniprot ID: Q86SR1
  ENSP ID: ENSP00000366889
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDRDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 65196 - protein, 366 aa, Homo sapiens
  Payload ID: 12981
  Gene Symbol: GALNT10
  Gene Name: polypeptide N-acetylgalactosaminyltransferase 10
  Uniprot ID: Q86SR1
  ENSP ID: ENSP00000415210
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVSQLSRRPVLGTAS

SEQ ID NO: 65197 - protein, 202 aa, Homo sapiens
  Payload ID: 12981
  Gene Symbol: GALNT10
  Gene Name: polypeptide N-acetylgalactosaminyltransferase 10
  ENSP ID: ENSP00000428573
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDRDLPTASTPSPFVC

SEQ ID NO: 65198 - protein, 202 aa, Homo sapiens
  Payload ID: 12982
  Gene Symbol: GALNT11
  Gene Name: polypeptide N-acetylgalactosaminyltransferase 11
  Uniprot ID: Q8NCW6
  ENSP ID: ENSP00000389449
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFGKECCTW

SEQ ID NO: 65199 - protein, 65 aa, Homo sapiens
  Payload ID: 12982
  Gene Symbol: GALNT11
  Gene Name: polypeptide N-acetylgalactosaminyltransferase 11
  ENSP ID: ENSP00000390247
  MOD_RES (1)..(1): Any amino acid
XIWMCGGKLFIIPCSRVGHIFRKRRPYGSPEGQDTMTHNSLRLAHVWLDEYKTQPTHADPPGSFP

SEQ ID NO: 65200 - protein, 151 aa, Homo sapiens
  Payload ID: 12982
  Gene Symbol: GALNT11
  Gene Name: polypeptide N-acetylgalactosaminyltransferase 11
  ENSP ID: ENSP00000393892
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELELRDLGYQKHAFNMLISDRLGYHRDVPDTRNAACKEKFYPPDLPAASVVICFY

SEQ ID NO: 65201 - protein, 98 aa, Homo sapiens
  Payload ID: 12982
  Gene Symbol: GALNT11
  Gene Name: polypeptide N-acetylgalactosaminyltransferase 11
  ENSP ID: ENSP00000395020
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSEL

SEQ ID NO: 65202 - protein, 133 aa, Homo sapiens
  Payload ID: 12982
  Gene Symbol: GALNT11
  Gene Name: polypeptide N-acetylgalactosaminyltransferase 11
  ENSP ID: ENSP00000395078
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELDVKKSSTHLTCQLLVLLSVSIMKRFLPCFGQCTVS

SEQ ID NO: 65203 - protein, 608 aa, Homo sapiens
  Payload ID: 12982
  Gene Symbol: GALNT11
  Gene Name: polypeptide N-acetylgalactosaminyltransferase 11
  Uniprot ID: Q8NCW6
  ENSP ID: ENSP00000395122
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 65204 - protein, 186 aa, Homo sapiens
  Payload ID: 12982
  Gene Symbol: GALNT11
  Gene Name: polypeptide N-acetylgalactosaminyltransferase 11
  ENSP ID: ENSP00000397581
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEI

SEQ ID NO: 65205 - protein, 202 aa, Homo sapiens; identical to SEQ ID NO: 65198
  Payload ID: 12982
  Gene Symbol: GALNT11
  Gene Name: polypeptide N-acetylgalactosaminyltransferase 11
  Uniprot ID: Q8NCW6
  ENSP ID: ENSP00000410093

SEQ ID NO: 65206 - protein, 160 aa, Homo sapiens
  Payload ID: 12982
  Gene Symbol: GALNT11
  Gene Name: polypeptide N-acetylgalactosaminyltransferase 11
  ENSP ID: ENSP00000412142
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFY

SEQ ID NO: 65207 - protein, 113 aa, Homo sapiens
  Payload ID: 12982
  Gene Symbol: GALNT11
  Gene Name: polypeptide N-acetylgalactosaminyltransferase 11
  ENSP ID: ENSP00000414890
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELDVKKSSTHLTCQLLV

SEQ ID NO: 65208 - protein, 608 aa, Homo sapiens; identical to SEQ ID NO: 65203
  Payload ID: 12982
  Gene Symbol: GALNT11
  Gene Name: polypeptide N-acetylgalactosaminyltransferase 11
  Uniprot ID: Q8NCW6
  ENSP ID: ENSP00000416787

SEQ ID NO: 65209 - protein, 581 aa, Homo sapiens [sequence omitted]

SEQ ID NO: 65210 - protein, 31 aa, Homo sapiens
  Payload ID: 12983
  Gene Symbol: GALNT12
  Gene Name: polypeptide N-acetylgalactosaminyltransferase 12
  ENSP ID: ENSP00000477657
  MOD_RES (1)..(1): Any amino acid
XINIYLSDRISLHRRLPERWNPLAPEGALGQ

SEQ ID NO: 65211 - protein, 556 aa, Homo sapiens
  Payload ID: 12984
  Gene Symbol: GALNT13
  Gene Name: polypeptide N-acetylgalactosaminyltransferase 13
  Uniprot ID: Q8IUC8
  ENSP ID: ENSP00000376570
MRRFVYCKVVLATSLMWVLVDVFLLLYFSECNKCDDKKERSLLPALRAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAERLTLRHVNSNQCLDEPSEEDKMVPTMQDCSGSRSQQWLLRNMTLGT

SEQ ID NO: 65212 - protein, 561 aa, Homo sapiens
  Payload ID: 12984
  Gene Symbol: GALNT13
  Gene Name: polypeptide N-acetylgalactosaminyltransferase 13
  Uniprot ID: Q8IUC8
  ENSP ID: ENSP00000387239
MRRFVYCKVVLATSLMWVLVDVFLLLYFSECNKCDDKKERSLLPALRAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAESCLSVNKVADGSQHPTVETCNDSTLQKWLLRNYTRMEIFRNIFGNSTDYIL

SEQ ID NO: 65213 - protein, 56 aa, Homo sapiens
  Payload ID: 12984
  Gene Symbol: GALNT13
  Gene Name: polypeptide N-acetylgalactosaminyltransferase 13
  ENSP ID: ENSP00000389447
  MOD_RES (1)..(1): Any amino acid
XISRNQEGPGEMGKAVLIPKDDQEKMKELFKINQFNLMASDLIALNRSLPDVRLEG

SEQ ID NO: 65214 - protein, 45 aa, Homo sapiens
  Payload ID: 12984
  Gene Symbol: GALNT13
  Gene Name: polypeptide N-acetylgalactosaminyltransferase 13
  ENSP ID: ENSP00000391469
LDNMGRKENEKVGIFNCHGMGGNQTQWTCNHVKMPPYERKSVMGI

SEQ ID NO: 65215 - protein, 106 aa, Homo sapiens
  Payload ID: 12984
  Gene Symbol: GALNT13
  Gene Name: polypeptide N-acetylgalactosaminyltransferase 13
  ENSP ID: ENSP00000396612
VFSYTADKEIRTDDLCLDVSRLNGPVIMLKCHHMRGNQLWEYDAETHTLLHIITQSCLSVNKVADGSQHPTVETCNDSTLQKWLLRNYTRMEIFRNIFGNSTDYIL

SEQ ID NO: 65216 - protein, 142 aa, Homo sapiens
  Payload ID: 12984
  Gene Symbol: GALNT13
  Gene Name: polypeptide N-acetylgalactosaminyltransferase 13
  ENSP ID: ENSP00000406237
  MOD_RES (1)..(1): Any amino acid
XISPGVVKVDYGDVSVRKTLRENLKCKPFSWYLENIYPDSQIPRRYYSLGEVFSYTADKEIRTDDLCLDVSRLNGPVIMLKCHHMRGNQLWEYDAERLTLRHVNSNQCLDEPSEEDKMVPTMQDCSGSRSQQWLLRNMTLGT

SEQ ID NO: 65217 - protein, 19 aa, Homo sapiens
  Payload ID: 12984
  Gene Symbol: GALNT13
  Gene Name: polypeptide N-acetylgalactosaminyltransferase 13
  ENSP ID: ENSP00000414403
MRRFVYCKVVLATSLMWVL

SEQ ID NO: 65218 - protein, 552 aa, Homo sapiens
  Payload ID: 12985
  Gene Symbol: GALNT14
  Gene Name: polypeptide N-acetylgalactosaminyltransferase 14
  Uniprot ID: Q96FL9
  ENSP ID: ENSP00000288988
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 65219 - protein, 557 aa, Homo sapiens
  Payload ID: 12985
  Gene Symbol: GALNT14
  Gene Name: polypeptide N-acetylgalactosaminyltransferase 14
  Uniprot ID: Q96FL9
  ENSP ID: ENSP00000314500
MRRLTRRLVLPVFGVLWITVLLFFWVTKRKLEVPTGPEVQTPKVWSLFFKVAGMSPWAPQVPVSPTPPYQRGHLPTGGHLAVCHFPCLLQEAQFHLQTQVFLQVRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 65220 - protein, 532 aa, Homo sapiens
  Payload ID: 12985
  Gene Symbol: GALNT14
  Gene Name: polypeptide N-acetylgalactosaminyltransferase 14
  Uniprot ID: Q96FL9
  ENSP ID: ENSP00000385435
MSFPMSLARSSVPFADSGLSSSQPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 65221 - protein, 38 aa, Homo sapiens
  Payload ID: 12985
  Gene Symbol: GALNT14
  Gene Name: polypeptide N-acetylgalactosaminyltransferase 14
  ENSP ID: ENSP00000398723
  MOD_RES (1)..(1): Any amino acid
XVFGVLWITVLLFFWVTKRKLEVPTGPEVQTPKGSSQS

SEQ ID NO: 65222 - protein, 70 aa, Homo sapiens
  Payload ID: 12985
  Gene Symbol: GALNT14
  Gene Name: polypeptide N-acetylgalactosaminyltransferase 14
  ENSP ID: ENSP00000399886
  MOD_RES (1)..(1): Any amino acid
XVFGVLWITVLLFFWVTKRKLEVPTGPEVQTPKVWSLFFKVAGMSPWAPQVPVSPTPPYQRGHLPTAFGR

SEQ ID NO: 65223 - protein, 400 aa, Homo sapiens
  Payload ID: 12985
  Gene Symbol: GALNT14
  Gene Name: polypeptide N-acetylgalactosaminyltransferase 14
  ENSP ID: ENSP00000406399
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLES

SEQ ID NO: 65224 - protein, 639 aa, Homo sapiens
  Payload ID: 12986
  Gene Symbol: GALNT15
  Gene Name: polypeptide N-acetylgalactosaminyltransferase 15
  Uniprot ID: Q8N3T1
  ENSP ID: ENSP00000344260
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 65225 - protein, 141 aa, Homo sapiens
  Payload ID: 12986
  Gene Symbol: GALNT15
  Gene Name: polypeptide N-acetylgalactosaminyltransferase 15
  ENSP ID: ENSP00000389079
ALPEVRHPLCLQQHPQDSLPTASVILCFHDEAWSTLLRTVHSILDTVPRAFLKEIILVDDLSQQGSHGFPPGSSGTTQVCSQRICGQAGGGEVTQEQQEAGCHQGPDAGGHQSHRGCARLHGCPLRVPPRLAGAPPQQNSW

SEQ ID NO: 65226 - protein, 617 aa, Homo sapiens
  Payload ID: 12986
  Gene Symbol: GALNT15
  Gene Name: polypeptide N-acetylgalactosaminyltransferase 15
  ENSP ID: ENSP00000395873
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQEDENRANSAAAEAYQRPLTFQQIVNNG

SEQ ID NO: 65227 - protein, 196 aa, Homo sapiens
  Payload ID: 12986
  Gene Symbol: GALNT15
  Gene Name: polypeptide N-acetylgalactosaminyltransferase 15
  ENSP ID: ENSP00000480229
MERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDEKPASSGVLTRSMLWMNDECQCQKEKRILAIKIQLQVNLKSLYIS

SEQ ID NO: 65228 - protein, 558 aa, Homo sapiens
  Payload ID: 12987
  Gene Symbol: GALNT16
  Gene Name: polypeptide N-acetylgalactosaminyltransferase 16
  Uniprot ID: Q8N428
  ENSP ID: ENSP00000336729
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQKWRRKGSFIQHSVSGLCLETKPAQLVTSKCQADAQAQQWQLLPHT

SEQ ID NO: 65229 - protein, 558 aa, Homo sapiens; identical to SEQ ID NO: 65228
  Payload ID: 12987
  Gene Symbol: GALNT16
  Gene Name: polypeptide N-acetylgalactosaminyltransferase 16
  Uniprot ID: Q8N428
  ENSP ID: ENSP00000402970

SEQ ID NO: 65230 - protein, 542 aa, Homo sapiens
  Payload ID: 12987
  Gene Symbol: GALNT16
  Gene Name: polypeptide N-acetylgalactosaminyltransferase 16
  Uniprot ID: Q8N428
  ENSP ID: ENSP00000451200
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQVSLLASGPEAQQPEGPCLRVADLGRRAPD

SEQ ID NO: 65231 - protein, 542 aa, Homo sapiens; identical to SEQ ID NO: 65230
  Payload ID: 12987
  Gene Symbol: GALNT16
  Gene Name: polypeptide N-acetylgalactosaminyltransferase 16
  Uniprot ID: Q8N428
  ENSP ID: ENSP00000451420

SEQ ID NO: 65232 - protein, 607 aa, Homo sapiens
  Payload ID: 12988
  Gene Symbol: GALNT18
  Gene Name: polypeptide N-acetylgalactosaminyltransferase 18
  Uniprot ID: Q6P9A2
  ENSP ID: ENSP00000227756
MVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHWGQELSPEGRRVALKQFQYYGYNAYLSDRLPLDRPLPDLRPSGCRNLSFPDSLPEVSIVFIFVNEALSVLLRSIHSAMERTPPHLLKEIILVDDNSSNEELKEKLTEYVDKVNSQKPGFIKVVRHSKQEGLIRSRVSGWRAATAPVVALFDAHVEFNVGWAEPVLTRIKENRKRIISPSFDNIKYDNFEIEEYPLAAQGFDWELWCRYLNPPKAWWKLENSTAPIRSPALIGCFIVDRQYFQEIGLLDEGMEVYGGENVELGIRVWQCGGSVEVLPCSRIAHIERAHKPYTEDLTAHVRRNALRVAEVWMDEFKSHVYMAWNIPQEDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQFSQGGPIQNRKSKRCLELQENSDLEFGFQLVLQKCSGQHWSITNVLRSLAS

SEQ ID NO: 65233 - protein, 571 aa, Homo sapiens
  Payload ID: 12989
  Gene Symbol: GALNT2
  Gene Name: polypeptide N-acetylgalactosaminyltransferase 2
  Uniprot ID: Q10471
  ENSP ID: ENSP00000355632
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 65234 - protein, 633 aa, Homo sapiens
  Payload ID: 12990
  Gene Symbol: GALNT3
  Gene Name: polypeptide N-acetylgalactosaminyltransferase 3
  Uniprot ID: Q14435
  ENSP ID: ENSP00000376465
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 65235 - protein, 371 aa, Homo sapiens
  Payload ID: 12990
  Gene Symbol: GALNT3
  Gene Name: polypeptide N-acetylgalactosaminyltransferase 3
  ENSP ID: ENSP00000386955
MYGYGCNIFPPSPSNLKGECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 65236 - protein, 89 aa, Homo sapiens
  Payload ID: 12990
  Gene Symbol: GALNT3
  Gene Name: polypeptide N-acetylgalactosaminyltransferase 3
  ENSP ID: ENSP00000391104
VHSVLYSSPAILLKEIILVDDASVDEYLHDKLDEYVKQFSIVKIVRQRERKGLITARLLGATVATAETLTFLDAHSFSTGDYSNDSPSR

SEQ ID NO: 65237 - protein, 90 aa, Homo sapiens
  Payload ID: 12990
  Gene Symbol: GALNT3
  Gene Name: polypeptide N-acetylgalactosaminyltransferase 3
  ENSP ID: ENSP00000397112
MAHLKRLVKLHIKRHYHKKFWKLGAVIFFFIIVLVLMQREVSVQYSKEESRMERNMKNKNKMLDLMLEAVNNIKDAMPKMQIGAPVRQNI

SEQ ID NO: 65238 - protein, 11 aa, Homo sapiens
  Payload ID: 12990
  Gene Symbol: GALNT3
  Gene Name: polypeptide N-acetylgalactosaminyltransferase 3
  ENSP ID: ENSP00000399880
MAHLKRLVKLH

SEQ ID NO: 65239 - protein, 464 aa, Homo sapiens
  Payload ID: 12990
  Gene Symbol: GALNT3
  Gene Name: polypeptide N-acetylgalactosaminyltransferase 3
  ENSP ID: ENSP00000412643
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQ

SEQ ID NO: 65240 - protein, 57 aa, Homo sapiens
  Payload ID: 12990
  Gene Symbol: GALNT3
  Gene Name: polypeptide N-acetylgalactosaminyltransferase 3
  ENSP ID: ENSP00000413477
MAHLKRLVKLHIKRHYHKKFWKLGAVIFFFIIVLVLMQREVSVQYSKEESRMERNMK

SEQ ID NO: 65241 - protein, 25 aa, Homo sapiens
  Payload ID: 12990
  Gene Symbol: GALNT3
  Gene Name: polypeptide N-acetylgalactosaminyltransferase 3
  ENSP ID: ENSP00000413694
MAHLKRLVKLHIKRHYHKKFWKLGA

SEQ ID NO: 65242 - protein, 578 aa, Homo sapiens
  Payload ID: 12991
  Gene Symbol: GALNT4
  Gene Name: polypeptide N-acetylgalactosaminyltransferase 4
  Uniprot ID: Q8N4A0
  ENSP ID: ENSP00000436604
MAVRWTWAGKSCLLLAFLTVAYIFVELLVSTFHASAGAGRARELGSRRLSDLQKNTEDLSRPLYKKPPADSRALGEWGKASKLQLNEDELKQQEELIERYAINIYLSDRISLHRHIEDKRMYECKSQKFNYRTLPTTSVIIAFYNEAWSTLLRTIHSVLETSPAVLLKEIILVDDLSDRVYLKTQLETYISNLDRVRLIRTNKREGLVRARLIGATFATGDVLTFLDCHCECNSGWLEPLLERIGRDETAVVCPVIDTIDWNTFEFYMQIGEPMIGGFDWRLTFQWHSVPKQERDRRISRIDPIRSPTMAGGLFAVSKKYFQYLGTYDTGMEVWGGENLELSFRVWQCGGKLEIHPCSHVGHVFPKRAPYARPNFLQNTARAAEVWMDEYKEHFYNRNPPARKEAYGDISERKLLRERLRCKSFDWYLKNVFPNLHVPEDRPGWHGAIRSRGISSECLDYNSPDNNPTGANLSLFGCHGQGGNQFFEYTSNKEIRFNSVTELCAEVPEQKNYVGMQNCPKDGFPVPANIIWHFKEDGTIFHPHSGLCLSAYRTPEGRPDVQMRTCDALDKNQIWSFEK

SEQ ID NO: 65243 - protein, 940 aa, Homo sapiens
  Payload ID: 12992
  Gene Symbol: GALNT5
  Gene Name: polypeptide N-acetylgalactosaminyltransferase 5
  Uniprot ID: Q7Z7M9
  ENSP ID: ENSP00000259056
MNRIRKFFRGSGRVLAFIFVASVIWLLFDMAALRLSFSEINTRVIKEDIVRRERIGFRVQPDQGKIFYSSIKEMKPPLRGHGKGAWGKENVRKTEESVLKVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSKLAAERDLNVTISLSTDRPKQRSQAVANERAHPASTAVPKSGEAMALNKTKTQSKEVNANKHKANTSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 65244 - protein, 622 aa, Homo sapiens
  Payload ID: 12993
  Gene Symbol: GALNT6
  Gene Name: polypeptide N-acetylgalactosaminyltransferase 6
  Uniprot ID: Q8NCL4
  ENSP ID: ENSP00000348668
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 65245 - protein, 622 aa, Homo sapiens; identical to SEQ ID NO: 65244
  Payload ID: 12993
  Gene Symbol: GALNT6
  Gene Name: polypeptide N-acetylgalactosaminyltransferase 6
  Uniprot ID: Q8NCL4
  ENSP ID: ENSP00000444171

SEQ ID NO: 65246 - protein, 68 aa, Homo sapiens
  Payload ID: 12993
  Gene Symbol: GALNT6
  Gene Name: polypeptide N-acetylgalactosaminyltransferase 6
  ENSP ID: ENSP00000473836
MRLLRRRHMPLRLAMVGCAFVLFLFLLHRDVSSREEATEKPWLKSLVSRKDHVLDLMLEAMNNLRDSM

SEQ ID NO: 65247 - protein, 78 aa, Homo sapiens
  Payload ID: 12993
  Gene Symbol: GALNT6
  Gene Name: polypeptide N-acetylgalactosaminyltransferase 6
  ENSP ID: ENSP00000473918
MRLLRRRHMPLRLAMVGCAFVLFLFLLHRDVSSREEATEKPWLKSLVSRKDHVLDLMLEAMNNLRDSMPKLQIRAPEA

SEQ ID NO: 65248 - protein, 55 aa, Homo sapiens
  Payload ID: 12993
  Gene Symbol: GALNT6
  Gene Name: polypeptide N-acetylgalactosaminyltransferase 6
  ENSP ID: ENSP00000473948
MRLLRRRHMPLRLAMVGCAFVLFLFLLHRDVSSREEATEKPWLKSLVSRKDHVLD

SEQ ID NO: 65249 - protein, 39 aa, Homo sapiens
  Payload ID: 12993
  Gene Symbol: GALNT6
  Gene Name: polypeptide N-acetylgalactosaminyltransferase 6
  ENSP ID: ENSP00000473981
MRLLRRRHMPLRLAMVGCAFVLFLFLLHRDVSSREEATE

SEQ ID NO: 65250 - protein, 62 aa, Homo sapiens
  Payload ID: 12993
  Gene Symbol: GALNT6
  Gene Name: polypeptide N-acetylgalactosaminyltransferase 6
  ENSP ID: ENSP00000474052
MRLLRRRHMPLRLAMVGCAFVLFLFLLHRDVSSREEATEKPWLKSLVSRKDHVLDLMLEAMN

SEQ ID NO: 65251 - protein, 137 aa, Homo sapiens
  Payload ID: 12993
  Gene Symbol: GALNT6
  Gene Name: polypeptide N-acetylgalactosaminyltransferase 6
  ENSP ID: ENSP00000474101
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGY

SEQ ID NO: 65252 - protein, 23 aa, Homo sapiens
  Payload ID: 12993
  Gene Symbol: GALNT6
  Gene Name: polypeptide N-acetylgalactosaminyltransferase 6
  ENSP ID: ENSP00000474163
MRLLRRRHMPLRLAMVGCAFVLF

SEQ ID NO: 65253 - protein, 23 aa, Homo sapiens
  Payload ID: 12993
  Gene Symbol: GALNT6
  Gene Name: polypeptide N-acetylgalactosaminyltransferase 6
  ENSP ID: ENSP00000474483
MRLLRRRHMPLRLAMVGCAFVLF

SEQ ID NO: 65254 - protein, 123 aa, Homo sapiens
  Payload ID: 12993
  Gene Symbol: GALNT6
  Gene Name: polypeptide N-acetylgalactosaminyltransferase 6
  ENSP ID: ENSP00000474515
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKS

SEQ ID NO: 65255 - protein, 365 aa, Homo sapiens
  Payload ID: 12993
  Gene Symbol: GALNT6
  Gene Name: polypeptide N-acetylgalactosaminyltransferase 6
  ENSP ID: ENSP00000474670
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKCGSVGASWRSSPALS

SEQ ID NO: 65256 - protein, 657 aa, Homo sapiens
  Payload ID: 12994
  Gene Symbol: GALNT7
  Gene Name: polypeptide N-acetylgalactosaminyltransferase 7
  Uniprot ID: Q86SF2
  ENSP ID: ENSP00000265000
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 65257 - protein, 383 aa, Homo sapiens
  Payload ID: 12994
  Gene Symbol: GALNT7
  Gene Name: polypeptide N-acetylgalactosaminyltransferase 7
  ENSP ID: ENSP00000427050
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTTCTVPLIDYIDGNDYSIEPQQGGDEDGFARGAWDWSLLWKRIPLSHKEKAKRKHKTEPYR

SEQ ID NO: 65258 - protein, 454 aa, Homo sapiens
  Payload ID: 12994
  Gene Symbol: GALNT7
  Gene Name: polypeptide N-acetylgalactosaminyltransferase 7
  ENSP ID: ENSP00000427095
  MOD_RES (1)..(1): Any amino acid
XNLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTTCTVPLIDYIDGNDYSIEPQQGGDEDGFARGAWDWSLLWKRIPLSHKEKAKRKHKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 65259 - protein, 199 aa, Homo sapiens
  Payload ID: 12994
  Gene Symbol: GALNT7
  Gene Name: polypeptide N-acetylgalactosaminyltransferase 7
  ENSP ID: ENSP00000427341
  MOD_RES (1)..(1): Any amino acid
XLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKVFCILTSEILYAFHFQ

SEQ ID NO: 65260 - protein, 637 aa, Homo sapiens
  Payload ID: 12995
  Gene Symbol: GALNT8
  Gene Name: polypeptide N-acetylgalactosaminyltransferase 8
  Uniprot ID: Q9NY28
  ENSP ID: ENSP00000252318
MMFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 65261 - protein, 529 aa, Homo sapiens
  Payload ID: 12995
  Gene Symbol: GALNT8
  Gene Name: polypeptide N-acetylgalactosaminyltransferase 8
  ENSP ID: ENSP00000408321
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 65262 - protein, 161 aa, Homo sapiens
  Payload ID: 12995
  Gene Symbol: GALNT8
  Gene Name: polypeptide N-acetylgalactosaminyltransferase 8
  ENSP ID: ENSP00000440383
  MOD_RES (1)..(1): Any amino acid
XYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPEKCWQVVQARTSMHRILTAAGPSTSSEDENPAWHRWQASGLTPLWRPPTSSNQARKS

SEQ ID NO: 65263 - protein, 88 aa, Homo sapiens
  Payload ID: 12995
  Gene Symbol: GALNT8
  Gene Name: polypeptide N-acetylgalactosaminyltransferase 8
  ENSP ID: ENSP00000444876
  MOD_RES (1)..(1): Any amino acid
XENVCLDQGPVPGNTPIMYYCHEFSSQNVYYHLTGELYVGQLIAEASASDRCLTDPGKAEKPTLEPCSKAAKNRLHIYWDFKPPTITK

SEQ ID NO: 65264 - protein, 603 aa, Homo sapiens
  Payload ID: 12996
  Gene Symbol: GALNT9
  Gene Name: polypeptide N-acetylgalactosaminyltransferase 9
  ENSP ID: ENSP00000329846
MAVARKIRTLLTVNILVFVGIVLFSVYCRLQGRSQELVRIVSGDRRVRSRHAKVGTLGDREAILQRLDHLEEVVYNQLNGLAKPIGLVEGPGGLGQGGLAATLRDDGQEAEGKYEEYGYNAQLSDRISLDRSIPDYRPRKCRQMSYAQDLPQVSVVFIFVNEALSVILRSVHSVVNHTPSQLLKEVILVDDNSDNVELKFNLDQYVNKRYPGLVKIVRNSRREGLIRARLQGWKAATAPVVGFFDAHVEFNTGWAEPALSRIREDRRRIVLPAIDNIKYSTFEVQQYANAAHGYNWGLWCMYIIPPQDWLDRGDESAPIRTPAMIGCSFVVDREYFGDIGLLDPGMEVYGGENVELGMRVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 65265 - protein, 237 aa, Homo sapiens
  Payload ID: 12996
  Gene Symbol: GALNT9
  Gene Name: polypeptide N-acetylgalactosaminyltransferase 9
  Uniprot ID: Q9HCQ5
  ENSP ID: ENSP00000380488
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 65266 - protein, 376 aa, Homo sapiens
  Payload ID: 12996
  Gene Symbol: GALNT9
  Gene Name: polypeptide N-acetylgalactosaminyltransferase 9
  ENSP ID: ENSP00000394446
  MOD_RES (1)..(1): Any amino acid
XIIPPQDWLDRGDESAPIRTPAMIGCSFVVDREYFGDIGLLDPGMEVYGGENVELGMRETEGFQQDKVNYKQNKRGRKTRQRVKRSRSEAHRAQPSPGATHGAHSRAPGPRTEPTAEPWGHARPTAALPATGVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 65267 - protein, 54 aa, Homo sapiens
  Payload ID: 12996
  Gene Symbol: GALNT9
  Gene Name: polypeptide N-acetylgalactosaminyltransferase 9
  ENSP ID: ENSP00000438221
MEVLPCSRVAHIERTRKPYNNDIDYYAKRNALRAAEVWMDDFKSHVYMAWNIPM

SEQ ID NO: 65268 - protein, 237 aa, Homo sapiens; identical to SEQ ID NO: 65265
  Payload ID: 12996
  Gene Symbol: GALNT9
  Gene Name: polypeptide N-acetylgalactosaminyltransferase 9
  Uniprot ID: Q9HCQ5
  ENSP ID: ENSP00000440544

SEQ ID NO: 65269 - protein, 96 aa, Homo sapiens
  Payload ID: 12996
  Gene Symbol: GALNT9
  Gene Name: polypeptide N-acetylgalactosaminyltransferase 9
  ENSP ID: ENSP00000444709
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNT

SEQ ID NO: 65270 - protein, 443 aa, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENSP ID: ENSP00000376548
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMCLQKHYPARLPTASIVICFYNEECNALFQTMSSVTNLTPHYFLEEIILVDDMSKVDDLKEKLDYHLETFRGKVKIIRNKKREGLIRARLIGASHASGDVLVFLDSHCEVNRVWLEPLLHAIAKDPKMVVCPLIDVIDDRTLEYKPSPLVRGTFDWNLQFKWDNVFSYEMDGPEGSTKPIRSPAMSGGIFAIRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 65271 - protein, 443 aa, Homo sapiens; identical to SEQ ID NO: 65270
  Payload ID: 12997
  Gene Symbol: GALNTL5
  Gene Name: polypeptide N-acetylgalactosaminyltransferase-like 5
  Uniprot ID: Q7Z4T8
  ENSP ID: ENSP00000392582

SEQ ID NO: 65272 - protein, 130 aa, Homo sapiens
  Payload ID: 12997
  Gene Symbol: GALNTL5
  Gene Name: polypeptide N-acetylgalactosaminyltransferase-like 5
  ENSP ID: ENSP00000398570
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKICTVTLLP

SEQ ID NO: 65273 - protein, 133 aa, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENSP ID: ENSP00000400106
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMGCSGVPGQPL

SEQ ID NO: 65274 - protein, 130 aa, Homo sapiens; identical to SEQ ID NO: 65272
  Payload ID: 12997
  Gene Symbol: GALNTL5
  Gene Name: polypeptide N-acetylgalactosaminyltransferase-like 5
  ENSP ID: ENSP00000406595

SEQ ID NO: 65275 - protein, 133 aa, Homo sapiens; identical to SEQ ID NO: 65273
  Payload ID: 12997
  Gene Symbol: GALNTL5
  Gene Name: polypeptide N-acetylgalactosaminyltransferase-like 5
  Uniprot ID: Q7Z4T8
  ENSP ID: ENSP00000411071

SEQ ID NO: 65276 - protein, 130 aa, Homo sapiens; identical to SEQ ID NO: 65272
  Payload ID: 12997
  Gene Symbol: GALNTL5
  Gene Name: polypeptide N-acetylgalactosaminyltransferase-like 5
  ENSP ID: ENSP00000414260

SEQ ID NO: 65277 - protein, 443 aa, Homo sapiens; identical to SEQ ID NO: 65270
  Payload ID: 12997
  Gene Symbol: GALNTL5
  Gene Name: polypeptide N-acetylgalactosaminyltransferase-like 5
  Uniprot ID: Q7Z4T8
  ENSP ID: ENSP00000479207

SEQ ID NO: 65278 - protein, 601 aa, Homo sapiens
  Payload ID: 12998
  Gene Symbol: GALNTL6
  Gene Name: polypeptide N-acetylgalactosaminyltransferase-like 6
  Uniprot ID: Q49A17
  ENSP ID: ENSP00000423313
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 65279 - protein, 584 aa, Homo sapiens
  Payload ID: 12998
  Gene Symbol: GALNTL6
  Gene Name: polypeptide N-acetylgalactosaminyltransferase-like 6
  Uniprot ID: Q49A17
  ENSP ID: ENSP00000423827
MRAKFRAGAGHQRNPSISADHGVHELVYQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 65280 - protein, 61 aa, Homo sapiens
  Payload ID: 12998
  Gene Symbol: GALNTL6
  Gene Name: polypeptide N-acetylgalactosaminyltransferase-like 6
  ENSP ID: ENSP00000425590
MKRKQKRFLQMTLLFTVALIFLPNVGLWSLYKDKHLVKSAEPGEQQVSATQRKITQGLVRQ

SEQ ID NO: 65281 - protein, 417 aa, Homo sapiens
  Payload ID: 12998
  Gene Symbol: GALNTL6
  Gene Name: polypeptide N-acetylgalactosaminyltransferase-like 6
  ENSP ID: ENSP00000483822
EHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 65282 - protein, 531 aa, Homo sapiens
  Payload ID: 12999
  Gene Symbol: PTBP1
  Gene Name: polypyrimidine tract binding protein 1
  Uniprot ID: P26599
  ENSP ID: ENSP00000014112
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65283 - protein, 527 aa, Homo sapiens
  Payload ID: 12999
  Gene Symbol: PTBP1
  Gene Name: polypyrimidine tract binding protein 1
  ENSP ID: ENSP00000342332
MSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65284 - protein, 557 aa, Homo sapiens
  Payload ID: 12999
  Gene Symbol: PTBP1
  Gene Name: polypyrimidine tract binding protein 1
  Uniprot ID: P26599
  ENSP ID: ENSP00000349428
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65285 - protein, 550 aa, Homo sapiens
  Payload ID: 12999
  Gene Symbol: PTBP1
  Gene Name: polypyrimidine tract binding protein 1
  Uniprot ID: P26599
  ENSP ID: ENSP00000408096
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65286 - protein, 256 aa, Homo sapiens
  Payload ID: 12999
  Gene Symbol: PTBP1
  Gene Name: polypyrimidine tract binding protein 1
  ENSP ID: ENSP00000465451
  MOD_RES (1)..(1): Any amino acid
XMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVKILFNKKENALVQMADGNQAQLAMSHLNGHKLHGKPIRITLSKHQNVQLPREGQED

SEQ ID NO: 65287 - protein, 237 aa, Homo sapiens
  Payload ID: 12999
  Gene Symbol: PTBP1
  Gene Name: polypyrimidine tract binding protein 1
  ENSP ID: ENSP00000465652
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQAAALQAVNSVQSGNLALAASAAAVDAGMAMAGQSPVLRIIVENLFYPVTLDVLHQIFSKFGTVLKIITFTKNNQFQALLQYADPVSAQHAKLS

SEQ ID NO: 65288 - protein, 56 aa, Homo sapiens
  Payload ID: 12999
  Gene Symbol: PTBP1
  Gene Name: polypyrimidine tract binding protein 1
  ENSP ID: ENSP00000465825
MRAGSIVPDIAVGTKRGSDELFSTCVTNGPFIMSSNSASAANGNDSKKFKGDSRSA

SEQ ID NO: 65289 - protein, 105 aa, Homo sapiens
  Payload ID: 12999
  Gene Symbol: PTBP1
  Gene Name: polypyrimidine tract binding protein 1
  ENSP ID: ENSP00000466250
  MOD_RES (1)..(1): Any amino acid
XFSTCVTNGPFIMSSNSASAANGNDSKKFKGDSRSAGVPSRVIHIRKLPIDVTEGEVISLGLPFGKVTNLLMLKGKNQGLTKDYGNSPLHRFKKPGSKNFQNIFP

SEQ ID NO: 65290 - protein, 149 aa, Homo sapiens
  Payload ID: 12999
  Gene Symbol: PTBP1
  Gene Name: polypyrimidine tract binding protein 1
  ENSP ID: ENSP00000468565
MSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAG

SEQ ID NO: 65291 - protein, 115 aa, Homo sapiens
  Payload ID: 12999
  Gene Symbol: PTBP1
  Gene Name: polypyrimidine tract binding protein 1
  ENSP ID: ENSP00000478097
  MOD_RES (1)..(1): Any amino acid
XNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPEASTVTCSA

SEQ ID NO: 65292 - protein, 227 aa, Homo sapiens
  Payload ID: 12999
  Gene Symbol: PTBP1
  Gene Name: polypyrimidine tract binding protein 1
  ENSP ID: ENSP00000478414
  MOD_RES (1)..(1): Any amino acid
XFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGLSVPNVHGALAPLAIPSAAAAAAAAGRIAIPGLAGAGNSVLLVSNLNPEASTVTCSA

SEQ ID NO: 65293 - protein, 81 aa, Homo sapiens
  Payload ID: 12999
  Gene Symbol: PTBP1
  Gene Name: polypyrimidine tract binding protein 1
  ENSP ID: ENSP00000478974
MADGNQAQLAMSHLNGHKLHGKPIRITLSKHQNVQLPREGQEDQGLTKDYGNSPLHRFKKPGSKNFQNIFPPSATLHLSNI

SEQ ID NO: 65294 - protein, 197 aa, Homo sapiens
  Payload ID: 12999
  Gene Symbol: PTBP1
  Gene Name: polypyrimidine tract binding protein 1
  ENSP ID: ENSP00000486218
MDGIVPDIAVGTKRVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65295 - protein, 588 aa, Homo sapiens
  Payload ID: 12999
  Gene Symbol: PTBP1
  Gene Name: polypyrimidine tract binding protein 1
  ENSP ID: ENSP00000489604
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQAVRGPAADPSSPGTSGVGPAAGAGDSRLCLPQRAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 65296 - protein, 537 aa, Homo sapiens
  Payload ID: 13000
  Gene Symbol: PTBP2
  Gene Name: polypyrimidine tract binding protein 2
  Uniprot ID: Q9UKA9
  ENSP ID: ENSP00000359216
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 65297 - protein, 536 aa, Homo sapiens
  Payload ID: 13000
  Gene Symbol: PTBP2
  Gene Name: polypyrimidine tract binding protein 2
  Uniprot ID: Q9UKA9
  ENSP ID: ENSP00000359217
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 65298 - protein, 531 aa, Homo sapiens
  Payload ID: 13000
  Gene Symbol: PTBP2
  Gene Name: polypyrimidine tract binding protein 2
  Uniprot ID: Q9UKA9
  ENSP ID: ENSP00000412788
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 65299 - protein, 532 aa, Homo sapiens
  Payload ID: 13000
  Gene Symbol: PTBP2
  Gene Name: polypyrimidine tract binding protein 2
  Uniprot ID: Q9UKA9
  ENSP ID: ENSP00000477024
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 65300 - protein, 182 aa, Homo sapiens
  Payload ID: 13001
  Gene Symbol: PTBP3
  Gene Name: polypyrimidine tract binding protein 3
  ENSP ID: ENSP00000210227
MDASPSPFSLPKKLNELSARRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLP

SEQ ID NO: 65301 - protein, 555 aa, Homo sapiens
  Payload ID: 13001
  Gene Symbol: PTBP3
  Gene Name: polypyrimidine tract binding protein 3
  Uniprot ID: O95758
  ENSP ID: ENSP00000334499
MDGVVTDLITVGLKRGSDELLSSGIINGPFTMNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 65302 - protein, 457 aa, Homo sapiens
  Payload ID: 13001
  Gene Symbol: PTBP3
  Gene Name: polypyrimidine tract binding protein 3
  Uniprot ID: O95758
  ENSP ID: ENSP00000340705
MAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 65303 - protein, 552 aa, Homo sapiens
  Payload ID: 13001
  Gene Symbol: PTBP3
  Gene Name: polypyrimidine tract binding protein 3
  Uniprot ID: O95758
  ENSP ID: ENSP00000363373
MDGVVTDLITVGLKRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 65304 - protein, 524 aa, Homo sapiens
  Payload ID: 13001
  Gene Symbol: PTBP3
  Gene Name: polypyrimidine tract binding protein 3
  Uniprot ID: O95758
  ENSP ID: ENSP00000363375
MNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 65305 - protein, 77 aa, Homo sapiens
  Payload ID: 13001
  Gene Symbol: PTBP3
  Gene Name: polypyrimidine tract binding protein 3
  ENSP ID: ENSP00000388024
MDGVVTDLITVGLKRGSDELLSSGIINGPFTMNSSTPSTGVYANGNDSKKFKRDRPPCSPSRVLHLRKIPCDVTEAE

SEQ ID NO: 65306 - protein, 558 aa, Homo sapiens
  Payload ID: 13001
  Gene Symbol: PTBP3
  Gene Name: polypyrimidine tract binding protein 3
  Uniprot ID: O95758
  ENSP ID: ENSP00000414921
MDASPSPFSLPKKLNELSARRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 65307 - protein, 179 aa, Homo sapiens
  Payload ID: 13002
  Gene Symbol: PNPT1
  Gene Name: polyribonucleotide nucleotidyltransferase 1
  ENSP ID: ENSP00000260604
MAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGGKYKSRD

SEQ ID NO: 65308 - protein, 783 aa, Homo sapiens
  Payload ID: 13002
  Gene Symbol: PNPT1
  Gene Name: polyribonucleotide nucleotidyltransferase 1
  Uniprot ID: Q8TCS8
  ENSP ID: ENSP00000393953
MAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 65309 - protein, 783 aa, Homo sapiens; identical to SEQ ID NO: 65308
  Payload ID: 13002
  Gene Symbol: PNPT1
  Gene Name: polyribonucleotide nucleotidyltransferase 1
  Uniprot ID: Q8TCS8
  ENSP ID: ENSP00000400646

SEQ ID NO: 65310 - protein, 139 aa, Homo sapiens
  Payload ID: 13002
  Gene Symbol: PNPT1
  Gene Name: polyribonucleotide nucleotidyltransferase 1
  ENSP ID: ENSP00000411057
  MOD_RES (1)..(1): Any amino acid
XDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEVLLLRKLCILLFPEIFLSP

SEQ ID NO: 65311 - protein, 71 aa, Homo sapiens
  Payload ID: 13002
  Gene Symbol: PNPT1
  Gene Name: polyribonucleotide nucleotidyltransferase 1
  ENSP ID: ENSP00000411994
MAACRYCCSCLRLRPLSDGPFLLPRRDRALTQLQVRALWSSAGSRAVAVDLGNRLTTDKKLLQQVEFPQTI

SEQ ID NO: 65312 - protein, 71 aa, Homo sapiens; identical to SEQ ID NO: 65311
  Payload ID: 13002
  Gene Symbol: PNPT1
  Gene Name: polyribonucleotide nucleotidyltransferase 1
  ENSP ID: ENSP00000486227

SEQ ID NO: 65313 - protein, 232 aa, Homo sapiens
  Payload ID: 13003
  Gene Symbol: PBDC1
  Gene Name: polysaccharide biosynthesis domain containing 1
  ENSP ID: ENSP00000362455
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEPPGYNSLPLKLLGTGKAITKLFISVFRTKKERKESTMEEKKELTVEKKRTPRMEERKELIVEKKKRKESTEKTKLTKEEKKGKKLTKKSTKVVKKLCKVYREQHSRSYDSIETTSTTVLLAQTPLVKCKFLYN

SEQ ID NO: 65314 - protein, 233 aa, Homo sapiens
  Payload ID: 13003
  Gene Symbol: PBDC1
  Gene Name: polysaccharide biosynthesis domain containing 1
  Uniprot ID: Q9BVG4
  ENSP ID: ENSP00000362456
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDKTDKGGEKGKEADKEINKSGEKAM

SEQ ID NO: 65315 - protein, 499 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000322016
MENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65316 - protein, 542 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000322036
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65317 - protein, 530 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000395417
MATATIALGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65318 - protein, 516 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000402953
MENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65319 - protein, 513 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000431960
MATATIALGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65320 - protein, 273 aa, Homo sapiens
  Payload ID: 13004
  Gene Symbol: PUF60
  Gene Name: poly-U binding splicing factor 60KDa
  ENSP ID: ENSP00000432091
  MOD_RES (1)..(1): Any amino acid
XYYELGEDTIRQAFAPFGPIKSIDMSWDSVTMKHKGFAFVEYEVPEAAQLALEQMNSVMLGGRNIKVRQGAKASIPQACRAAPPRKPFVAGPGLTGLSISPPLPQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPI

SEQ ID NO: 65321 - protein, 322 aa, Homo sapiens
  Payload ID: 13004
  Gene Symbol: PUF60
  Gene Name: poly-U binding splicing factor 60KDa
  ENSP ID: ENSP00000432610
MATATIALVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQVRAH

SEQ ID NO: 65322 - protein, 228 aa, Homo sapiens
  Payload ID: 13004
  Gene Symbol: PUF60
  Gene Name: poly-U binding splicing factor 60KDa
  ENSP ID: ENSP00000433403
MEQLNLADSGLVGKEARRCRRASPPMGMPSAWWLQNEAGCLFAARQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMN

SEQ ID NO: 65323 - protein, 559 aa, Homo sapiens
  Payload ID: 13004
  Gene Symbol: PUF60
  Gene Name: poly-U binding splicing factor 60KDa
  Uniprot ID: Q9UHX1
  ENSP ID: ENSP00000434359
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65324 - protein, 263 aa, Homo sapiens
  Payload ID: 13004
  Gene Symbol: PUF60
  Gene Name: poly-U binding splicing factor 60KDa
  ENSP ID: ENSP00000434863
MEQLNLADSGLVGKEARRCRRASPPMGMPSAWWLQNEAGCLFAARQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIK

SEQ ID NO: 65325 - protein, 336 aa, Homo sapiens
  Payload ID: 13004
  Gene Symbol: PUF60
  Gene Name: poly-U binding splicing factor 60KDa
  ENSP ID: ENSP00000436131
  MOD_RES (1)..(1): Any amino acid
XTATIALVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQVR

SEQ ID NO: 65326 - protein, 247 aa, Homo sapiens
  Payload ID: 13004
  Gene Symbol: PUF60
  Gene Name: poly-U binding splicing factor 60KDa
  ENSP ID: ENSP00000437309
MEQLNLADSGLVGKEARRCRRASPPMGMPSAWWLQNEAGCLFAARQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNR

SEQ ID NO: 65327 - protein, 530 aa, Homo sapiens; identical to SEQ ID NO: 65317
  Payload ID: 13004
  Gene Symbol: PUF60
  Gene Name: poly-U binding splicing factor 60KDa
  Uniprot ID: Q9UHX1
  ENSP ID: ENSP00000478209

SEQ ID NO: 65328 - protein, 542 aa, Homo sapiens; identical to SEQ ID NO: 65316
  Payload ID: 13004
  Gene Symbol: PUF60
  Gene Name: poly-U binding splicing factor 60KDa
  Uniprot ID: Q9UHX1
  ENSP ID: ENSP00000478495

SEQ ID NO: 65329 - protein, 559 aa, Homo sapiens; identical to SEQ ID NO: 65323
  Payload ID: 13004
  Gene Symbol: PUF60
  Gene Name: poly-U binding splicing factor 60KDa
  Uniprot ID: Q9UHX1
  ENSP ID: ENSP00000484860

SEQ ID NO: 65330 - protein, 534 aa, Homo sapiens
  Payload ID: 13004
  Gene Symbol: PUF60
  Gene Name: poly-U binding splicing factor 60KDa
  ENSP ID: ENSP00000487614
QVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65331 - protein, 314 aa, Homo sapiens
  Payload ID: 13004
  Gene Symbol: PUF60
  Gene Name: poly-U binding splicing factor 60KDa
  ENSP ID: ENSP00000487637
VNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQVRAH

SEQ ID NO: 65332 - protein, 247 aa, Homo sapiens; identical to SEQ ID NO: 65326
  Payload ID: 13004
  Gene Symbol: PUF60
  Gene Name: poly-U binding splicing factor 60KDa
  ENSP ID: ENSP00000487894

SEQ ID NO: 65333 - protein, 499 aa, Homo sapiens; identical to SEQ ID NO: 65315
  Payload ID: 13004
  Gene Symbol: PUF60
  Gene Name: poly-U binding splicing factor 60KDa
  Uniprot ID: Q9UHX1
  ENSP ID: ENSP00000487930

SEQ ID NO: 65334 - protein, 516 aa, Homo sapiens; identical to SEQ ID NO: 65318
  Payload ID: 13004
  Gene Symbol: PUF60
  Gene Name: poly-U binding splicing factor 60KDa
  Uniprot ID: Q9UHX1
  ENSP ID: ENSP00000487945

SEQ ID NO: 65335 - protein, 329 aa, Homo sapiens
  Payload ID: 13004
  Gene Symbol: PUF60
  Gene Name: poly-U binding splicing factor 60KDa
  ENSP ID: ENSP00000488027
VNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQVR

SEQ ID NO: 65336 - protein, 263 aa, Homo sapiens; identical to SEQ ID NO: 65324
  Payload ID: 13004
  Gene Symbol: PUF60
  Gene Name: poly-U binding splicing factor 60KDa
  ENSP ID: ENSP00000488281

SEQ ID NO: 65337 - protein, 228 aa, Homo sapiens; identical to SEQ ID NO: 65322
  Payload ID: 13004
  Gene Symbol: PUF60
  Gene Name: poly-U binding splicing factor 60KDa
  ENSP ID: ENSP00000488339

SEQ ID NO: 65338 - protein, 273 aa, Homo sapiens; identical to SEQ ID NO: 65320
  Payload ID: 13004
  Gene Symbol: PUF60
  Gene Name: poly-U binding splicing factor 60KDa
  ENSP ID: ENSP00000488399
  MOD_RES (1)..(1): Any amino acid

SEQ ID NO: 65339 - protein, 522 aa, Homo sapiens
  Payload ID: 13004
  Gene Symbol: PUF60
  Gene Name: poly-U binding splicing factor 60KDa
  ENSP ID: ENSP00000488435
GTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65340 - protein, 551 aa, Homo sapiens
  Payload ID: 13004
  Gene Symbol: PUF60
  Gene Name: poly-U binding splicing factor 60KDa
  ENSP ID: ENSP00000488595
QVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65341 - protein, 505 aa, Homo sapiens
  Payload ID: 13004
  Gene Symbol: PUF60
  Gene Name: poly-U binding splicing factor 60KDa
  ENSP ID: ENSP00000488903
GTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 65342 - protein, 115 aa, Homo sapiens
  Payload ID: 13005
  Gene Symbol: POMZP3
  Gene Name: POM121 and ZP3 fusion
  Uniprot ID: Q6PJE2
  ENSP ID: ENSP00000275569
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNM

SEQ ID NO: 65343 - protein, 187 aa, Homo sapiens
  Payload ID: 13005
  Gene Symbol: POMZP3
  Gene Name: POM121 and ZP3 fusion
  Uniprot ID: Q6PJE2
  ENSP ID: ENSP00000309233
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNMIYITCHLKVTLAEQDPDELNKACSFSKPSNSWFPVEGLADICQCCNKGDCGTPSHSRRQPRVVSQWSTSASL

SEQ ID NO: 65344 - protein, 250 aa, Homo sapiens
  Payload ID: 13005
  Gene Symbol: POMZP3
  Gene Name: POM121 and ZP3 fusion
  ENSP ID: ENSP00000405319
MVCSPVTLRIAPPDRRFSRSAIPEQIISSTLSSPSSNAPDPCAKETVLSALKEKKKKRTVEEEDQIFLDGQENKRRPSLSLSPRLVQWCNFGSLHPLPPRFKRFSCLSLPSRWITGVHCCTQLIFVFLVETRFHHVCQASLELLTSSDPPTLASQSAGIMGVSHGARPTCLALTPFCFLPSCLVDGLTDASSAFKVPRPGPDTLQFTVDVFHFANDSRNMIYITCHLKVTLAEQDPDELNKACSFSKPSN

SEQ ID NO: 65345 - protein, 154 aa, Homo sapiens
  Payload ID: 13005
  Gene Symbol: POMZP3
  Gene Name: POM121 and ZP3 fusion
  ENSP ID: ENSP00000416591
MVCSPVTLRIAPPDRRFSRSAIPEQIISSTLSSPSSNAPDPCAKETVLSALKEKKKKRTVEEEDQIFLDGQENKRRPSLSLSPRLVQWCNFGSLHPLPPRFKRFSCLSLPSRWITAVLSTVSLMPLLHSKFLDPGQIHSSSQWMSSTLLMTPET

SEQ ID NO: 65346 - protein, 124 aa, Homo sapiens
  Payload ID: 13005
  Gene Symbol: POMZP3
  Gene Name: POM121 and ZP3 fusion
  ENSP ID: ENSP00000416963
  MOD_RES (1)..(1): Any amino acid
XCLVDGLTDASSAFKVPRPGPDTLQFTVDVFHFANDSRNMIYITCHLKVTLAEQDPDELNKACSFSKPSNRQQKSKLLLFHLSWFPVEGLADICQCCNKGDCGTPSHSRRQPRVVSQWSTSASL

SEQ ID NO: 65347 - protein, 187 aa, Homo sapiens; identical to SEQ ID NO: 65343
  Payload ID: 13005
  Gene Symbol: POMZP3
  Gene Name: POM121 and ZP3 fusion
  Uniprot ID: Q6PJE2
  ENSP ID: ENSP00000477906

SEQ ID NO: 65348 - protein, 115 aa, Homo sapiens; identical to SEQ ID NO: 65342
  Payload ID: 13005
  Gene Symbol: POMZP3
  Gene Name: POM121 and ZP3 fusion
  Uniprot ID: Q6PJE2
  ENSP ID: ENSP00000484663

SEQ ID NO: 65349 - protein, 250 aa, Homo sapiens; identical to SEQ ID NO: 65344
  Payload ID: 13005
  Gene Symbol: POMZP3
  Gene Name: POM121 and ZP3 fusion
  ENSP ID: ENSP00000488074

SEQ ID NO: 65350 - protein, 154 aa, Homo sapiens; identical to SEQ ID NO: 65345
  Payload ID: 13005
  Gene Symbol: POMZP3
  Gene Name: POM121 and ZP3 fusion
  ENSP ID: ENSP00000488216

SEQ ID NO: 65351 - protein, 124 aa, Homo sapiens; identical to SEQ ID NO: 65346
  Payload ID: 13005
  Gene Symbol: POMZP3
  Gene Name: POM121 and ZP3 fusion
  ENSP ID: ENSP00000488442
  MOD_RES (1)..(1): Any amino acid

SEQ ID NO: 65352 - protein, 984 aa, Homo sapiens
  Payload ID: 13006
  Gene Symbol: POM121
  Gene Name: POM121 transmembrane nucleoporin
  Uniprot ID: Q96HA1
  ENSP ID: ENSP00000351124
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 65353 - protein, 999 aa, Homo sapiens
  Payload ID: 13006
  Gene Symbol: POM121
  Gene Name: POM121 transmembrane nucleoporin
  Uniprot ID: Q96HA1
  ENSP ID: ENSP00000378687
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGNTFAHQQEHSPRKGPNNLSKRKLLPAVRAQGLPRRGQASSFPTRKE

SEQ ID NO: 65354 - protein, 999 aa, Homo sapiens; identical to SEQ ID NO: 65353
  Payload ID: 13006
  Gene Symbol: POM121
  Gene Name: POM121 transmembrane nucleoporin
  Uniprot ID: Q96HA1
  ENSP ID: ENSP00000393020

SEQ ID NO: 65355 - protein, 1249 aa, Homo sapiens
  Payload ID: 13006
  Gene Symbol: POM121
  Gene Name: POM121 transmembrane nucleoporin
  Uniprot ID: Q96HA1
  ENSP ID: ENSP00000405562
MSPAAAAAGAGERRRPIASVRDGRGRGCGGPARAVLLGLSLVGLLLYLVPAAAALAWLTVGATAAWWGLSREPRGSRPLSSFVRKARHRRPLSSFVRKARHRRTLFASPLAKSTANGNLLEPRTLLEGPDPAELLLMGSYLGKPGPPQPAAAPEGQDLRDRPGRRPPARPAPRSPPPRSPPPRSPPPSPPTHRAHHVYPSLPTPLLRPSRRPSPRDCGTLPNRFVITPRRRYPIHQAQYSCLGVLPTVCWNGYHKKAVLSPRNSRMVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 65356 - protein, 984 aa, Homo sapiens; identical to SEQ ID NO: 65352
  Payload ID: 13006
  Gene Symbol: POM121
  Gene Name: POM121 transmembrane nucleoporin
  Uniprot ID: Q96HA1
  ENSP ID: ENSP00000486504

SEQ ID NO: 65357 - protein, 42 aa, Homo sapiens
  Payload ID: 13007
  Gene Symbol: POM121C
  Gene Name: POM121 transmembrane nucleoporin C
  ENSP ID: ENSP00000381415
MVCSPVTVRIAPPDRRFSRSAIPEQIISSTLSSPSSNAPDPC

SEQ ID NO: 65358 - protein, 107 aa, Homo sapiens
  Payload ID: 13007
  Gene Symbol: POM121C
  Gene Name: POM121 transmembrane nucleoporin C
  ENSP ID: ENSP00000410033
MSSLTGAYTSGIPSSSRNAITSSYSSTRGISQLWKRNGPSSSPFSSPASSRSQTPERPAKKIREEELCHHSSSSTPLAADKESQGEKAADTTPRKKQNSNSQSTPGS

SEQ ID NO: 65359 - protein, 1229 aa, Homo sapiens
  Payload ID: 13007
  Gene Symbol: POM121C
  Gene Name: POM121 transmembrane nucleoporin C
  ENSP ID: ENSP00000476236
MSPAAAAAGAGERRRPIASVRDGRGRGCGGPAGAALLGLSLVGLLLYLVPAAAALAWLAVGTTAAWWGLSREPRGSRPLSSFVQKARHRRTLFASPPAKSTANGNLLEPRTLLEGPDPAELLLMGSYLGKPGPPQPAPAPEGQDLRNRPGRRPPARPAPRSTPPSQPTHRVHHFYPSLPTPLLRPSGRPSPRDRGTLPDRFVITPRRRYPIHQTQYSCPGVLPTVCWNGYHKKAVLSPRNSRMVCSPVTVRIAPPDRRFSRSAIPEQIISSTLSSPSSNAPDPCAKETVLSALKEKKKKRTVEEEDQIFLDGQENKRRRHDSSGSGHSAFEPLVASGVPASFVPKPGSLKRGLNSQSSDDHLNKRSRSSSMSSLTGAYTSGIPSSSRNAITSSYSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLPPPPQLGYSITAEDLDLEKKASLQWFNQALEDKSDAASNSVTETPPTTQPSFTFTLPAAATASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGLTPPGPSVSATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 65360 - protein, 987 aa, Homo sapiens
  Payload ID: 13007
  Gene Symbol: POM121C
  Gene Name: POM121 transmembrane nucleoporin C
  ENSP ID: ENSP00000481575
MVCSPVTVRIAPPDRRFSRSAIPEQIISSTLSSPSSNAPDPCAKETVLSALKEKKKKRTVEEEDQIFLDGQENKRRRHDSSGSGHSAFEPLVASGVPASFVPKPGSLKRGLNSQSSDDHLNKRSRSSSMSSLTGAYTSGIPSSSRNAITSSYSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLPPPPQLGYSITAEDLDLEKKASLQWFNQALEDKSDAASNSVTETPPTTQPSFTFTLPAAATASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGLTPPGPSVSATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 65361 - protein, 296 aa, Homo sapiens
  Payload ID: 13008
  Gene Symbol: POM121L12
  Gene Name: POM121 transmembrane nucleoporin-like 12
  Uniprot ID: Q8N7R1
  ENSP ID: ENSP00000386133
MGAAAPAESADLGNFWKAGEPLLQGPDALAAPMSRSPSTPQTTPSPQGRQSPWPLRSLTQSHIQYFQWGRPVPSTHLIEVRPTQDPAKPQRVVSEGWRRPALPGETALGRDLSCAWEGCMKGGLCRAWNPGRTWSPVTIGIAPPERQESPWRSPGQRARPAGRPAAQELLDPCTRETLLGALSQCPKGSARFDGPLWFEVSDSKGGRRNLQPRPSAFKPLSKNGAVASFVPRPGPLKPSLGPWSLSFCDDAWPSVLVQPAPSAIWDFWEATTPSCGSCSRVSFALEVTQSAGPFGS

SEQ ID NO: 65362 - protein, 1035 aa, Homo sapiens
  Payload ID: 13009
  Gene Symbol: POM121L2
  Gene Name: POM121 transmembrane nucleoporin-like 2
  Uniprot ID: Q96KW2
  ENSP ID: ENSP00000392726
MGSFLSKLELSPSSPAQVRTDLPERPTKRRPPQPLHQVHRVQFVHRAHPAPRYRPVRRRPNLDPANPTTWLANEAWRRFPMKKSQNSPLGPLPSDWWESYLKRTIWSLRHPRPIWSPVTIRITPPDQRVPPSTSPEDVIALAGLPPSEELADPCSKETVLRALRECRKGKGRLEEPLFPESLDSKRRSPETRPSAFKPLMKNGTLTSFVPRPGPLKRSLHSWGSDHSLTKRPNCSSMSSLASIYRGGTLSSKRNAIGSSYSSCRNFSDPWKRSVPSVSFETPEWPIKKEKSCHRPSSPVPLVSDFESLGGSESSGQQNQKIPQLPSSPENLVSEIPPPQLGYAVSDENLTLGKKAELQVSNNAGEDTTEVNTDPFPETWLAIQPSLSLALPSSETDLTQGANPQLENLRKMQKSLGPLASPQSTGEATSVAHSPLKTPSLPTPPGCSQSELLPGTSPDSKPTATFILLTPTSPTLPVTDTTWPPSTSQADRSPMPPDPPAPPTIQSTLLGMVSSPTSHLSASAPPDATSAHLMLKPILGPLHNSEIGSSSYSRISVTAAASSISSLSTIQGTLTPTFKPIFGSIDPLKTTPMIAPFSSKQTPPPFTHASTHHFHGLVKATSVVMSTTLASTSKDSVFKPPLDFGVVNVTSAVGNTYSVPSTCDTFLLGTAQAFRADFTPATGFIFPPHHHPTIPTVHTVTMFTQVLSSVVQISPRSSTANFRGMGSPLPASALVSTNWLASTPSISNLTPAITSPLGSSSRPPFPLSQGANPQPAFGATNGQKQGPSQPALMPSVSSSFLFGSSAVALPTPMPTPAQPAFISTTQSALGCLTPSASTSQTPASTWSGIGGIPAGFPISQASTTGFRIVIQTHQSGAFGSVFGSRAPQPFTFGGFVTPMDCDESGIIMTGPDMSPTSGAFSIGALPSGTTNTMIPFGKGWSQNTEGLPSHRTAFSLGRGSISARKTMAPIAQNTPVPGQAKAGSSVGFGMPFPPAQGSVGRGPFRSSASSFSIGAKSKTPKNREKGHSRRHHAYKK

SEQ ID NO: 65363 - protein, 92 aa, Homo sapiens
  Payload ID: 13009
  Gene Symbol: POM121L2
  Gene Name: POM121 transmembrane nucleoporin-like 2
  ENSP ID: ENSP00000415181
KKEKSCHRPSSPVPLVSDFESLGGSESSGQQNQKIPQLPSSPENLVSEIPPPQLGYAVSDENLTLGKKAELQHFPGIWKVLNSEMVLFLQIC

SEQ ID NO: 65364 - protein, 462 aa, Homo sapiens
  Payload ID: 13010
  Gene Symbol: POM121L7
  Gene Name: POM121 transmembrane nucleoporin-like 7
  ENSP ID: ENSP00000383394
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLALRNDSSTSEASRPSTHKFPLLPRRRGEPLMLPPPLELGYRVTVEDLDREKEAAFQRINSALQVEDKAISDCRPSRPSHTLSSLATGASGLPPVSKAPSMDAQQETHKSQDCLGLLAPLASAAGVPSTAPMSGKKHRPPGPLFSSSDPLPATSSHSQDSAQVTSLIPAPFPAASMDAGMRRTRCGTSAPAAAAAAPPPSTLNPTLGSLLEWMEALHISGPQPQLQQVPRGQNQRSQTSRTSSCPKRNAISSPYRSTGGLPERKRRRGPASSHCQLTLSS

SEQ ID NO: 65365 - protein, 1024 aa, Homo sapiens
  Payload ID: 13011
  Gene Symbol: POP1
  Gene Name: POP1 homolog, ribonuclease P/MRP subunit
  Uniprot ID: Q99575
  ENSP ID: ENSP00000339529
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMLSSQPAAQRGLVLLRPPASLQYRFARIAIEV

SEQ ID NO: 65366 - protein, 1024 aa, Homo sapiens; identical to SEQ ID NO: 65365
  Payload ID: 13011
  Gene Symbol: POP1
  Gene Name: POP1 homolog, ribonuclease P/MRP subunit
  Uniprot ID: Q99575
  ENSP ID: ENSP00000385787

SEQ ID NO: 65367 - protein, 183 aa, Homo sapiens
  Payload ID: 13011
  Gene Symbol: POP1
  Gene Name: POP1 homolog, ribonuclease P/MRP subunit
  ENSP ID: ENSP00000428945
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARR

SEQ ID NO: 65368 - protein, 96 aa, Homo sapiens
  Payload ID: 13012
  Gene Symbol: POP4
  Gene Name: POP4 homolog, ribonuclease P/MRP subunit
  ENSP ID: ENSP00000221770
MIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 65369 - protein, 220 aa, Homo sapiens
  Payload ID: 13012
  Gene Symbol: POP4
  Gene Name: POP4 homolog, ribonuclease P/MRP subunit
  Uniprot ID: O95707
  ENSP ID: ENSP00000465213
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 65370 - protein, 42 aa, Homo sapiens
  Payload ID: 13012
  Gene Symbol: POP4
  Gene Name: POP4 homolog, ribonuclease P/MRP subunit
  ENSP ID: ENSP00000465456
MKSVIYHALSQKEANDSDVQVSSWQGVQEQQSLQEHSGPRPS

SEQ ID NO: 65371 - protein, 150 aa, Homo sapiens
  Payload ID: 13012
  Gene Symbol: POP4
  Gene Name: POP4 homolog, ribonuclease P/MRP subunit
  ENSP ID: ENSP00000467990
MGPGYLLLRSPNRTATGMGPPYLRKTEGWSTGVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDT

SEQ ID NO: 65372 - protein, 181 aa, Homo sapiens
  Payload ID: 13012
  Gene Symbol: POP4
  Gene Name: POP4 homolog, ribonuclease P/MRP subunit
  ENSP ID: ENSP00000468215
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQSLFLPLHELWKQYIRDLCSGLKPDTQPQMIQAKLLKADLHGAIISVTKSKCPSYVGITGILLQETKHIFKIITKEDRLKVIPKLNCV

SEQ ID NO: 65373 - protein, 40 aa, Homo sapiens
  Payload ID: 13012
  Gene Symbol: POP4
  Gene Name: POP4 homolog, ribonuclease P/MRP subunit
  ENSP ID: ENSP00000468718
MKSVIYHALSQKEANDSDVQPSGAQRAEAFVRAFLKRSHR

SEQ ID NO: 65374 - protein, 113 aa, Homo sapiens
  Payload ID: 13013
  Gene Symbol: POP5
  Gene Name: POP5 homolog, ribonuclease P/MRP subunit
  Uniprot ID: Q969H6
  ENSP ID: ENSP00000341791
MVRFKHRYLLCELVSDDPRCRLSLDDRVLSSLVRDTIARVHGTFGAAACSIGFAGTIRTCQKFLIQYNRRQLLILLQNCTDEGEREAIQKSVTRSCLLEEEEESGEEAAEAME

SEQ ID NO: 65375 - protein, 163 aa, Homo sapiens
  Payload ID: 13013
  Gene Symbol: POP5
  Gene Name: POP5 homolog, ribonuclease P/MRP subunit
  Uniprot ID: Q969H6
  ENSP ID: ENSP00000350098
MVRFKHRYLLCELVSDDPRCRLSLDDRVLSSLVRDTIARVHGTFGAAACSIGFAVRYLNAYTGIVLLRCRKEFYQLVWSALPFITYLENKGHRYPCFFNTLHVGGTIRTCQKFLIQYNRRQLLILLQNCTDEGEREAIQKSVTRSCLLEEEEESGEEAAEAME

SEQ ID NO: 65376 - protein, 140 aa, Homo sapiens
  Payload ID: 13014
  Gene Symbol: POP7
  Gene Name: POP7 homolog, ribonuclease P/MRP subunit
  Uniprot ID: O75817
  ENSP ID: ENSP00000304353
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRVTPK

SEQ ID NO: 65377 - protein, 137 aa, Homo sapiens
  Payload ID: 13014
  Gene Symbol: POP7
  Gene Name: POP7 homolog, ribonuclease P/MRP subunit
  ENSP ID: ENSP00000387814
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRV

SEQ ID NO: 65378 - protein, 364 aa, Homo sapiens
  Payload ID: 13015
  Gene Symbol: POPDC2
  Gene Name: popeye domain containing 2
  Uniprot ID: Q9HBU9
  ENSP ID: ENSP00000264231
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILASRIPLQSYSQVISRGQAPLAPTHTPEL

SEQ ID NO: 65379 - protein, 368 aa, Homo sapiens
  Payload ID: 13015
  Gene Symbol: POPDC2
  Gene Name: popeye domain containing 2
  ENSP ID: ENSP00000340753
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILGEDSTSLVLEDFEEVSGSESFMDYRSDGEYMR

SEQ ID NO: 65380 - protein, 368 aa, Homo sapiens; identical to SEQ ID NO: 65379
  Payload ID: 13015
  Gene Symbol: POPDC2
  Gene Name: popeye domain containing 2
  ENSP ID: ENSP00000417250

SEQ ID NO: 65381 - protein, 360 aa, Homo sapiens
  Payload ID: 13015
  Gene Symbol: POPDC2
  Gene Name: popeye domain containing 2
  Uniprot ID: Q9HBU9
  ENSP ID: ENSP00000420715
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILEIDDFPSYFHQFGFSGKVAAGRIP

SEQ ID NO: 65382 - protein, 25 aa, Homo sapiens
  Payload ID: 13015
  Gene Symbol: POPDC2
  Gene Name: popeye domain containing 2
  ENSP ID: ENSP00000420795
  MOD_RES (1)..(1): Any amino acid
XPLQSYSQVISRGQAPLAPTHTPEL

SEQ ID NO: 65383 - protein, 291 aa, Homo sapiens
  Payload ID: 13016
  Gene Symbol: POPDC3
  Gene Name: popeye domain containing 3
  Uniprot ID: Q9HBV1
  ENSP ID: ENSP00000254765
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 65384 - protein, 101 aa, Homo sapiens
  Payload ID: 13016
  Gene Symbol: POPDC3
  Gene Name: popeye domain containing 3
  ENSP ID: ENSP00000414409
MLFLCFDRIRVTVDGEFLHYIFPLQFLDSPEWDSLRPTEEGIFQVTLTAETDCRYVSWRRKKLYLLFAQHRYISRLFSVLIGSDIADKLYALNDRVYIGKR

SEQ ID NO: 65385 - protein, 461 aa, Homo sapiens
  Payload ID: 13017
  Gene Symbol: PORCN
  Gene Name: porcupine homolog (Drosophila)
  Uniprot ID: Q9H237
  ENSP ID: ENSP00000322304
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 65386 - protein, 405 aa, Homo sapiens
  Payload ID: 13017
  Gene Symbol: PORCN
  Gene Name: porcupine homolog (Drosophila)
  ENSP ID: ENSP00000347207
GLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 65387 - protein, 456 aa, Homo sapiens
  Payload ID: 13017
  Gene Symbol: PORCN
  Gene Name: porcupine homolog (Drosophila)
  Uniprot ID: Q9H237
  ENSP ID: ENSP00000348233
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 65388 - protein, 455 aa, Homo sapiens
  Payload ID: 13017
  Gene Symbol: PORCN
  Gene Name: porcupine homolog (Drosophila)
  Uniprot ID: Q9H237
  ENSP ID: ENSP00000352946
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 65389 - protein, 450 aa, Homo sapiens
  Payload ID: 13017
  Gene Symbol: PORCN
  Gene Name: porcupine homolog (Drosophila)
  Uniprot ID: Q9H237
  ENSP ID: ENSP00000354978
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 65390 - protein, 455 aa, Homo sapiens; identical to SEQ ID NO: 65388
  Payload ID: 13017
  Gene Symbol: PORCN
  Gene Name: porcupine homolog (Drosophila)
  Uniprot ID: Q9H237
  ENSP ID: ENSP00000356546

SEQ ID NO: 65391 - protein, 86 aa, Homo sapiens
  Payload ID: 13017
  Gene Symbol: PORCN
  Gene Name: porcupine homolog (Drosophila)
  ENSP ID: ENSP00000418644
MATFSRQEFFQQLLQGCLLPTAQQGLDQIWLLLAICLACRLLWRLAAHGLGRAAQPPVLPRAVPLPTFLPSRRLPIRHHPHLPTHG

SEQ ID NO: 65392 - protein, 97 aa, Homo sapiens
  Payload ID: 13017
  Gene Symbol: PORCN
  Gene Name: porcupine homolog (Drosophila)
  ENSP ID: ENSP00000419212
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGV

SEQ ID NO: 65393 - protein, 50 aa, Homo sapiens
  Payload ID: 13017
  Gene Symbol: PORCN
  Gene Name: porcupine homolog (Drosophila)
  ENSP ID: ENSP00000419858
MATFSRQEFFQQLLQGCLLPTAQQGLDQIWLLLAICLACRLLWRLVRCTW

SEQ ID NO: 65394 - protein, 150 aa, Homo sapiens
  Payload ID: 13017
  Gene Symbol: PORCN
  Gene Name: porcupine homolog (Drosophila)
  ENSP ID: ENSP00000420445
MYLTSHAFPQSSSTVPLHGLGSPKLKCECQSASFKRGLPHGHPLPLCPCFDRSIHLAIHPWGSAMATFSRQEFFQQLLQGCLLPTAQQGLDQIWLLLAICLACRLLWRLAAHGLGRAAQPPVLPRAVPLPTFLPSRRLPIRHHPHLPTHG

SEQ ID NO: 65395 - protein, 86 aa, Homo sapiens; identical to SEQ ID NO: 65391
  Payload ID: 13017
  Gene Symbol: PORCN
  Gene Name: porcupine homolog (Drosophila)
  ENSP ID: ENSP00000431224

SEQ ID NO: 65396 - protein, 456 aa, Homo sapiens; identical to SEQ ID NO: 65387
  Payload ID: 13017
  Gene Symbol: PORCN
  Gene Name: porcupine homolog (Drosophila)
  Uniprot ID: Q9H237
  ENSP ID: ENSP00000446401

SEQ ID NO: 65397 - protein, 81 aa, Homo sapiens; identical to SEQ ID NO: 39247
  Payload ID: 13018
  Gene Symbol: HMBS
  Gene Name: Porphobilinogen deaminase
  ENSP ID: ENSP00000485967

SEQ ID NO: 65398 - protein, 119 aa, Homo sapiens; identical to SEQ ID NO: 39240
  Payload ID: 13018
  Gene Symbol: HMBS
  Gene Name: Porphobilinogen deaminase
  ENSP ID: ENSP00000486071

SEQ ID NO: 65399 - protein, 187 aa, Homo sapiens; identical to SEQ ID NO: 39242
  Payload ID: 13018
  Gene Symbol: HMBS
  Gene Name: Porphobilinogen deaminase
  ENSP ID: ENSP00000486081

SEQ ID NO: 65400 - protein, 187 aa, Homo sapiens; identical to SEQ ID NO: 39242
  Payload ID: 13018
  Gene Symbol: HMBS
  Gene Name: Porphobilinogen deaminase
  ENSP ID: ENSP00000486122

SEQ ID NO: 65401 - protein, 361 aa, Homo sapiens [sequence omitted]

SEQ ID NO: 65402 - protein, 344 aa, Homo sapiens; identical to SEQ ID NO: 39237
  Payload ID: 13018
  Gene Symbol: HMBS
  Gene Name: Porphobilinogen deaminase
  ENSP ID: ENSP00000486199

SEQ ID NO: 65403 - protein, 81 aa, Homo sapiens; identical to SEQ ID NO: 39246
  Payload ID: 13018
  Gene Symbol: HMBS
  Gene Name: Porphobilinogen deaminase
  ENSP ID: ENSP00000486348

SEQ ID NO: 65404 - protein, 304 aa, Homo sapiens; identical to SEQ ID NO: 39244
  Payload ID: 13018
  Gene Symbol: HMBS
  Gene Name: Porphobilinogen deaminase
  ENSP ID: ENSP00000486658

SEQ ID NO: 65405 - protein, 191 aa, Homo sapiens; identical to SEQ ID NO: 39249
  Payload ID: 13018
  Gene Symbol: HMBS
  Gene Name: Porphobilinogen deaminase
  ENSP ID: ENSP00000486721

SEQ ID NO: 65406 - protein, 321 aa, Homo sapiens; identical to SEQ ID NO: 39239
  Payload ID: 13018
  Gene Symbol: HMBS
  Gene Name: Porphobilinogen deaminase
  ENSP ID: ENSP00000486742

SEQ ID NO: 65407 - protein, 63 aa, Homo sapiens; identical to SEQ ID NO: 39241
  Payload ID: 13018
  Gene Symbol: HMBS
  Gene Name: Porphobilinogen deaminase
  ENSP ID: ENSP00000486861

SEQ ID NO: 65408 - protein, 344 aa, Homo sapiens; identical to SEQ ID NO: 39237
  Payload ID: 13018
  Gene Symbol: HMBS
  Gene Name: Porphobilinogen deaminase
  ENSP ID: ENSP00000486979

SEQ ID NO: 65409 - protein, 330 aa, Homo sapiens; identical to SEQ ID NO: 39248
  Payload ID: 13018
  Gene Symbol: HMBS
  Gene Name: Porphobilinogen deaminase
  ENSP ID: ENSP00000487285

SEQ ID NO: 65410 - protein, 344 aa, Homo sapiens; identical to SEQ ID NO: 39237
  Payload ID: 13018
  Gene Symbol: HMBS
  Gene Name: Porphobilinogen deaminase
  ENSP ID: ENSP00000487456

SEQ ID NO: 65411 - protein, 922 aa, Homo sapiens
  Payload ID: 13019
  Gene Symbol: PGAP1
  Gene Name: post-GPI attachment to proteins 1
  Uniprot ID: Q75T13
  ENSP ID: ENSP00000346809
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVRFHGGALPAYVVSNILLAYRGQLYSLFSTGCCLEYATMLDKEAKPYKVDPFVIIIKFLLGYKWFKELWDVLLLPELDAVILTCQSMCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 65412 - protein, 182 aa, Homo sapiens
  Payload ID: 13019
  Gene Symbol: PGAP1
  Gene Name: post-GPI attachment to proteins 1
  ENSP ID: ENSP00000363870
MFLHSVNLWNLAFYVFMVFLATLGLWDVFFGFEENKCSMSYMFEYPEYQSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACIN

SEQ ID NO: 65413 - protein, 304 aa, Homo sapiens
  Payload ID: 13019
  Gene Symbol: PGAP1
  Gene Name: post-GPI attachment to proteins 1
  ENSP ID: ENSP00000386802
MEVLESKKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGI

SEQ ID NO: 65414 - protein, 592 aa, Homo sapiens
  Payload ID: 13019
  Gene Symbol: PGAP1
  Gene Name: post-GPI attachment to proteins 1
  Uniprot ID: Q75T13
  ENSP ID: ENSP00000387028
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVA

SEQ ID NO: 65415 - protein, 159 aa, Homo sapiens
  Payload ID: 13019
  Gene Symbol: PGAP1
  Gene Name: post-GPI attachment to proteins 1
  ENSP ID: ENSP00000390555
SPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLSKLLKTTSQFPLPLAVGVIAFGSAHLYRLPCFVFIPLLLHALCNFM

SEQ ID NO: 65416 - protein, 50 aa, Homo sapiens
  Payload ID: 13019
  Gene Symbol: PGAP1
  Gene Name: post-GPI attachment to proteins 1
  ENSP ID: ENSP00000415405
MFLHSVNLWNLAFYVFMVFLATLGLWDVFFGFEENKCSMSYMFEYPEYQR

SEQ ID NO: 65417 - protein, 315 aa, Homo sapiens
  Payload ID: 13020
  Gene Symbol: PGAP2
  Gene Name: post-GPI attachment to proteins 2
  Uniprot ID: Q9UHJ9
  ENSP ID: ENSP00000278243
MYQVPLPLDRDGTLVRLRFTMVALVTVCCPLVAFLFCILWSLLFHFKETTATHCGATPCRMFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 65418 - protein, 307 aa, Homo sapiens
  Payload ID: 13020
  Gene Symbol: PGAP2
  Gene Name: post-GPI attachment to proteins 2
  Uniprot ID: Q9UHJ9
  ENSP ID: ENSP00000300730
MARLGSTGGVSGRVVTQHRDSAPFLGAPRLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTDRKSYSWKQRLFIINFISFFSALAVYFRHNMYCEAGVYTIFAILEYTVVLTNMAFHMTAWWDFGNKELLITSQPEEKRF

SEQ ID NO: 65419 - protein, 311 aa, Homo sapiens
  Payload ID: 13020
  Gene Symbol: PGAP2
  Gene Name: post-GPI attachment to proteins 2
  ENSP ID: ENSP00000380183
MARLGSTGGVSGRVVTQHRDSAPFLGAPRLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 65420 - protein, 272 aa, Homo sapiens
  Payload ID: 13020
  Gene Symbol: PGAP2
  Gene Name: post-GPI attachment to proteins 2
  ENSP ID: ENSP00000380188
MGPWYGSASPWWPWSRSAVHLSPSSSASSGPCSSTSRRQRPHTVGTEASIGVPGIKMDGGDAQEHGHFLRLPQVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 65421 - protein, 98 aa, Homo sapiens
  Payload ID: 13020
  Gene Symbol: PGAP2
  Gene Name: post-GPI attachment to proteins 2
  ENSP ID: ENSP00000380190
MLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 65422 - protein, 232 aa, Homo sapiens
  Payload ID: 13020
  Gene Symbol: PGAP2
  Gene Name: post-GPI attachment to proteins 2
  Uniprot ID: Q9UHJ9
  ENSP ID: ENSP00000431851
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEVRSIPSGGSKAAQKKIKDICPQDSGSQVLQLETAALHHQLHLLLLGAGCLLSAQHVL

SEQ ID NO: 65423 - protein, 81 aa, Homo sapiens
  Payload ID: 13020
  Gene Symbol: PGAP2
  Gene Name: post-GPI attachment to proteins 2
  ENSP ID: ENSP00000432123
MYQVPLPLDRDGTLVRLRFTMVALVTVCCPLVAFLFCILWSLLFHFKETTATHCGPSTKMLSLCSLPHPSGTCSSPAFSGG

SEQ ID NO: 65424 - protein, 56 aa, Homo sapiens
  Payload ID: 13020
  Gene Symbol: PGAP2
  Gene Name: post-GPI attachment to proteins 2
  ENSP ID: ENSP00000432215
MYQVPLPLDRDGTLVRLRFTMVALVTVCCPLVAFLFCILWSLLFHFKETTATHCGD

SEQ ID NO: 65425 - protein, 98 aa, Homo sapiens; identical to SEQ ID NO: 65421
  Payload ID: 13020
  Gene Symbol: PGAP2
  Gene Name: post-GPI attachment to proteins 2
  ENSP ID: ENSP00000432721

SEQ ID NO: 65426 - protein, 182 aa, Homo sapiens
  Payload ID: 13020
  Gene Symbol: PGAP2
  Gene Name: post-GPI attachment to proteins 2
  ENSP ID: ENSP00000433377
MLLHKSQDSWGMRIQHFGPRTWKERSFGRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 65427 - protein, 208 aa, Homo sapiens
  Payload ID: 13020
  Gene Symbol: PGAP2
  Gene Name: post-GPI attachment to proteins 2
  ENSP ID: ENSP00000433748
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEVRSIPSGGSKAAQKKIKDICPQDSGNGEVGTEF

SEQ ID NO: 65428 - protein, 234 aa, Homo sapiens
  Payload ID: 13020
  Gene Symbol: PGAP2
  Gene Name: post-GPI attachment to proteins 2
  ENSP ID: ENSP00000434088
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEVRSIPSGGSKAAQKKIKDICPQDSGNGSQVLQLETAALHHQLHLLLLGAGCLLSAQHVL

SEQ ID NO: 65429 - protein, 211 aa, Homo sapiens
  Payload ID: 13020
  Gene Symbol: PGAP2
  Gene Name: post-GPI attachment to proteins 2
  ENSP ID: ENSP00000434401
MVEMHKNMVISLDYPRQVPVCGGDGEGATMLLHKSQDSWGMRIQHFGPRTWKERSFGRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 65430 - protein, 56 aa, Homo sapiens; identical to SEQ ID NO: 65424
  Payload ID: 13020
  Gene Symbol: PGAP2
  Gene Name: post-GPI attachment to proteins 2
  ENSP ID: ENSP00000434419

SEQ ID NO: 65431 - protein, 245 aa, Homo sapiens
  Payload ID: 13020
  Gene Symbol: PGAP2
  Gene Name: post-GPI attachment to proteins 2
  ENSP ID: ENSP00000434507
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTDRKSYSWKQRLFIINFISFFSALAVYFRHNMYCEAGVYTIFAILEYTVVLTNMAFHMTAWWDFGNKELLITSQP

SEQ ID NO: 65432 - protein, 315 aa, Homo sapiens; identical to SEQ ID NO: 65417
  Payload ID: 13020
  Gene Symbol: PGAP2
  Gene Name: post-GPI attachment to proteins 2
  Uniprot ID: Q9UHJ9
  ENSP ID: ENSP00000434631

SEQ ID NO: 65433 - protein, 94 aa, Homo sapiens
  Payload ID: 13020
  Gene Symbol: PGAP2
  Gene Name: post-GPI attachment to proteins 2
  ENSP ID: ENSP00000434772
MLLTCILWRLTKKHTDRKSYSWKQRLFIINFISFFSALAVYFRHNMYCEAGVYTIFAILEYTVVLTNMAFHMTAWWDFGNKELLITSQPEEKRF

SEQ ID NO: 65434 - protein, 254 aa, Homo sapiens
  Payload ID: 13020
  Gene Symbol: PGAP2
  Gene Name: post-GPI attachment to proteins 2
  Uniprot ID: Q9UHJ9
  ENSP ID: ENSP00000435223
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 65435 - protein, 94 aa, Homo sapiens; identical to SEQ ID NO: 65433
  Payload ID: 13020
  Gene Symbol: PGAP2
  Gene Name: post-GPI attachment to proteins 2
  ENSP ID: ENSP00000435338

SEQ ID NO: 65436 - protein, 78 aa, Homo sapiens
  Payload ID: 13020
  Gene Symbol: PGAP2
  Gene Name: post-GPI attachment to proteins 2
  ENSP ID: ENSP00000435703
MLLTCILWRLTKKHTVSQEVRSIPSGGSKAAQKKIKDICPQDSGNGSQVLQLETAALHHQLHLLLLGAGCLLSAQHVL

SEQ ID NO: 65437 - protein, 98 aa, Homo sapiens; identical to SEQ ID NO: 65421
  Payload ID: 13020
  Gene Symbol: PGAP2
  Gene Name: post-GPI attachment to proteins 2
  ENSP ID: ENSP00000435799

SEQ ID NO: 65438 - protein, 81 aa, Homo sapiens; identical to SEQ ID NO: 65423
  Payload ID: 13020
  Gene Symbol: PGAP2
  Gene Name: post-GPI attachment to proteins 2
  ENSP ID: ENSP00000437203

SEQ ID NO: 65439 - protein, 56 aa, Homo sapiens; identical to SEQ ID NO: 65424
  Payload ID: 13020
  Gene Symbol: PGAP2
  Gene Name: post-GPI attachment to proteins 2
  ENSP ID: ENSP00000481391

SEQ ID NO: 65440 - protein, 56 aa, Homo sapiens; identical to SEQ ID NO: 65424
  Payload ID: 13020
  Gene Symbol: PGAP2
  Gene Name: post-GPI attachment to proteins 2
  ENSP ID: ENSP00000482118

SEQ ID NO: 65441 - protein, 320 aa, Homo sapiens
  Payload ID: 13021
  Gene Symbol: PGAP3
  Gene Name: post-GPI attachment to proteins 3
  Uniprot ID: Q96FM1
  ENSP ID: ENSP00000300658
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 65442 - protein, 269 aa, Homo sapiens
  Payload ID: 13021
  Gene Symbol: PGAP3
  Gene Name: post-GPI attachment to proteins 3
  Uniprot ID: Q96FM1
  ENSP ID: ENSP00000367250
MAGLAARLVLLAGAAALASGSQGDREPVYRDCVLQCEEQNCSGGALNHFRSRQPIYMSLAGWTCRDDCKYECMWVTVGLYLQEGHKVPQFHGKVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 65443 - protein, 299 aa, Homo sapiens
  Payload ID: 13021
  Gene Symbol: PGAP3
  Gene Name: post-GPI attachment to proteins 3
  Uniprot ID: Q96FM1
  ENSP ID: ENSP00000415765
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 65444 - protein, 150 aa, Homo sapiens
  Payload ID: 13021
  Gene Symbol: PGAP3
  Gene Name: post-GPI attachment to proteins 3
  ENSP ID: ENSP00000463011
  MOD_RES (1)..(1): Any amino acid
XARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWMRKLRHSKAK

SEQ ID NO: 65445 - protein, 148 aa, Homo sapiens
  Payload ID: 13021
  Gene Symbol: PGAP3
  Gene Name: post-GPI attachment to proteins 3
  ENSP ID: ENSP00000463234
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWLSGR

SEQ ID NO: 65446 - protein, 70 aa, Homo sapiens
  Payload ID: 13021
  Gene Symbol: PGAP3
  Gene Name: post-GPI attachment to proteins 3
  ENSP ID: ENSP00000463785
MWVTVGLYLQEGHKVPQFHGKWPFSRFLFFQEPASAVASFLNGLASLVMLCRYRTFVPASSPMYHTCVAF

SEQ ID NO: 65447 - protein, 44 aa, Homo sapiens
  Payload ID: 13021
  Gene Symbol: PGAP3
  Gene Name: post-GPI attachment to proteins 3
  ENSP ID: ENSP00000464308
SFLNGLASLVMLCRYRTFVPASSPMYHTCVAFAWMRKLRHSKAK

SEQ ID NO: 65448 - protein, 240 aa, Homo sapiens
  Payload ID: 13021
  Gene Symbol: PGAP3
  Gene Name: post-GPI attachment to proteins 3
  ENSP ID: ENSP00000478028
MKDVGPESCGQPTPCWPSPALESVLGKASQHLGLESGQPLYLLELNWGGTECALSSTGRTAACFLPISLLPTSPAAWLGPEALCLPGRPGTTGLRDTGGPLLLPPPTLLQDTTRWCWMLVLWPAKVHGDSPHGILRDQAAGIGKEFHPDHCPSQVPRRPHHTPFQGQGSSKPRARILCCCLVESLPPCVGSVGQAECIGDRAVSMGLGVCELRPRCAVWRRVLSGKRCGFKVCVCRGWVC

SEQ ID NO: 65449 - protein, 319 aa, Homo sapiens
  Payload ID: 13021
  Gene Symbol: PGAP3
  Gene Name: post-GPI attachment to proteins 3
  ENSP ID: ENSP00000480165
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLQRKWTTSVPPLSSYTQSTCAASGPWGCSTQLWSVPSGLLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 65450 - protein, 381 aa, Homo sapiens
  Payload ID: 13022
  Gene Symbol: KCMF1
  Gene Name: potassium channel modulatory factor 1
  Uniprot ID: Q9P0J7
  ENSP ID: ENSP00000386738
MSRHEGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 65451 - protein, 149 aa, Homo sapiens
  Payload ID: 13022
  Gene Symbol: KCMF1
  Gene Name: potassium channel modulatory factor 1
  ENSP ID: ENSP00000391340
MQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIA

SEQ ID NO: 65452 - protein, 47 aa, Homo sapiens
  Payload ID: 13022
  Gene Symbol: KCMF1
  Gene Name: potassium channel modulatory factor 1
  ENSP ID: ENSP00000409499
MQCILTRVDFDLYYGGEAFSVEQPQSFTCPYCGKMGYTETSLQEHVT

SEQ ID NO: 65453 - protein, 10 aa, Homo sapiens
  Payload ID: 13022
  Gene Symbol: KCMF1
  Gene Name: potassium channel modulatory factor 1
  ENSP ID: ENSP00000414214
MQCILTRVDF

SEQ ID NO: 65454 - protein, 272 aa, Homo sapiens
  Payload ID: 13023
  Gene Symbol: KCNRG
  Gene Name: potassium channel regulator
  Uniprot ID: Q8N5I3
  ENSP ID: ENSP00000324191
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRYVSIKPDNRKLANGTNVLGLLIDTLLKEGFHLVSTRTVSSEDKTECYSFERIKSPEVLITNETPKPETIIIPEQSQIKK

SEQ ID NO: 65455 - protein, 229 aa, Homo sapiens
  Payload ID: 13023
  Gene Symbol: KCNRG
  Gene Name: potassium channel regulator
  Uniprot ID: Q8N5I3
  ENSP ID: ENSP00000353661
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRLVCNGVISAHHNLRLWGSSDSPASASRVAGITGMFL

SEQ ID NO: 65456 - protein, 191 aa, Homo sapiens
  Payload ID: 13024
  Gene Symbol: KCNMB1
  Gene Name: potassium channel subfamily M regulatory beta subunit 1
  Uniprot ID: Q16558
  ENSP ID: ENSP00000274629
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 65457 - protein, 130 aa, Homo sapiens
  Payload ID: 13024
  Gene Symbol: KCNMB1
  Gene Name: potassium channel subfamily M regulatory beta subunit 1
  Uniprot ID: Q16558
  ENSP ID: ENSP00000427940
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQVLNWRDGDTSLYPCQVCEPVPNCPCPRG

SEQ ID NO: 65458 - protein, 235 aa, Homo sapiens
  Payload ID: 13025
  Gene Symbol: KCNMB2
  Gene Name: potassium channel subfamily M regulatory beta subunit 2
  Uniprot ID: Q9Y691
  ENSP ID: ENSP00000351068
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 65459 - protein, 137 aa, Homo sapiens
  Payload ID: 13025
  Gene Symbol: KCNMB2
  Gene Name: potassium channel subfamily M regulatory beta subunit 2
  ENSP ID: ENSP00000395807
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIK

SEQ ID NO: 65460 - protein, 235 aa, Homo sapiens; identical to SEQ ID NO: 65458
  Payload ID: 13025
  Gene Symbol: KCNMB2
  Gene Name: potassium channel subfamily M regulatory beta subunit 2
  Uniprot ID: Q9Y691
  ENSP ID: ENSP00000397483

SEQ ID NO: 65461 - protein, 100 aa, Homo sapiens
  Payload ID: 13025
  Gene Symbol: KCNMB2
  Gene Name: potassium channel subfamily M regulatory beta subunit 2
  ENSP ID: ENSP00000399100
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFS

SEQ ID NO: 65462 - protein, 235 aa, Homo sapiens; identical to SEQ ID NO: 65458
  Payload ID: 13025
  Gene Symbol: KCNMB2
  Gene Name: potassium channel subfamily M regulatory beta subunit 2
  Uniprot ID: Q9Y691
  ENSP ID: ENSP00000407592

SEQ ID NO: 65463 - protein, 235 aa, Homo sapiens; identical to SEQ ID NO: 65458
  Payload ID: 13025
  Gene Symbol: KCNMB2
  Gene Name: potassium channel subfamily M regulatory beta subunit 2
  Uniprot ID: Q9Y691
  ENSP ID: ENSP00000408252

SEQ ID NO: 65464 - protein, 26 aa, Homo sapiens
  Payload ID: 13025
  Gene Symbol: KCNMB2
  Gene Name: potassium channel subfamily M regulatory beta subunit 2
  ENSP ID: ENSP00000414228
MFIWTSGRTSSSYRHDEKSRDGVSPC

SEQ ID NO: 65465 - protein, 216 aa, Homo sapiens
  Payload ID: 13025
  Gene Symbol: KCNMB2
  Gene Name: potassium channel subfamily M regulatory beta subunit 2
  ENSP ID: ENSP00000484788
MFIWTSGRTSSSYRHDEKRNIYQKIRDHDLLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 65466 - protein, 279 aa, Homo sapiens
  Payload ID: 13026
  Gene Symbol: KCNMB3
  Gene Name: potassium channel subfamily M regulatory beta subunit 3
  Uniprot ID: Q9NPA1
  ENSP ID: ENSP00000319370
MDFSPSSELGFHFVAFILLTRHRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 65467 - protein, 277 aa, Homo sapiens
  Payload ID: 13026
  Gene Symbol: KCNMB3
  Gene Name: potassium channel subfamily M regulatory beta subunit 3
  Uniprot ID: Q9NPA1
  ENSP ID: ENSP00000327866
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 65468 - protein, 275 aa, Homo sapiens
  Payload ID: 13026
  Gene Symbol: KCNMB3
  Gene Name: potassium channel subfamily M regulatory beta subunit 3
  Uniprot ID: Q9NPA1
  ENSP ID: ENSP00000376451
MFPLLYELTAVSPSPFPQRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 65469 - protein, 257 aa, Homo sapiens
  Payload ID: 13026
  Gene Symbol: KCNMB3
  Gene Name: potassium channel subfamily M regulatory beta subunit 3
  Uniprot ID: Q9NPA1
  ENSP ID: ENSP00000376452
MTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 65470 - protein, 173 aa, Homo sapiens
  Payload ID: 13026
  Gene Symbol: KCNMB3
  Gene Name: potassium channel subfamily M regulatory beta subunit 3
  Uniprot ID: Q9NPA1
  ENSP ID: ENSP00000417091
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKRDVTDCRVKEKQTLTVSDEHKQ

SEQ ID NO: 65471 - protein, 257 aa, Homo sapiens; identical to SEQ ID NO: 65469
  Payload ID: 13026
  Gene Symbol: KCNMB3
  Gene Name: potassium channel subfamily M regulatory beta subunit 3
  Uniprot ID: Q9NPA1
  ENSP ID: ENSP00000418536

SEQ ID NO: 65472 - protein, 64 aa, Homo sapiens
  Payload ID: 13026
  Gene Symbol: KCNMB3
  Gene Name: potassium channel subfamily M regulatory beta subunit 3
  ENSP ID: ENSP00000479162
CFYTPKCHQDRNDLLNSALDIKEFFDHKNGTPFSCFYSPASQSEDVILIKNVMLQTAELKKSRH

SEQ ID NO: 65473 - protein, 210 aa, Homo sapiens
  Payload ID: 13027
  Gene Symbol: KCNMB4
  Gene Name: potassium channel subfamily M regulatory beta subunit 4
  Uniprot ID: Q86W47
  ENSP ID: ENSP00000258111
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 65474 - protein, 44 aa, Homo sapiens
  Payload ID: 13027
  Gene Symbol: KCNMB4
  Gene Name: potassium channel subfamily M regulatory beta subunit 4
  ENSP ID: ENSP00000431137
  MOD_RES (1)..(1): Any amino acid
XSYIPPCKRENQKNLESVMNWQQYWKDEIGSQPFTCYFNQHQRS

SEQ ID NO: 65475 - protein, 257 aa, Homo sapiens
  Payload ID: 13028
  Gene Symbol: KCTD1
  Gene Name: potassium channel tetramerization domain containing 1
  Uniprot ID: Q719H9
  ENSP ID: ENSP00000314831
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 65476 - protein, 257 aa, Homo sapiens; identical to SEQ ID NO: 65475
  Payload ID: 13028
  Gene Symbol: KCTD1
  Gene Name: potassium channel tetramerization domain containing 1
  Uniprot ID: Q719H9
  ENSP ID: ENSP00000384367

SEQ ID NO: 65477 - protein, 257 aa, Homo sapiens; identical to SEQ ID NO: 65475
  Payload ID: 13028
  Gene Symbol: KCTD1
  Gene Name: potassium channel tetramerization domain containing 1
  Uniprot ID: Q719H9
  ENSP ID: ENSP00000408405

SEQ ID NO: 65478 - protein, 208 aa, Homo sapiens
  Payload ID: 13028
  Gene Symbol: KCTD1
  Gene Name: potassium channel tetramerization domain containing 1
  ENSP ID: ENSP00000462470
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLE

SEQ ID NO: 65479 - protein, 257 aa, Homo sapiens; identical to SEQ ID NO: 65475
  Payload ID: 13028
  Gene Symbol: KCTD1
  Gene Name: potassium channel tetramerization domain containing 1
  Uniprot ID: Q719H9
  ENSP ID: ENSP00000463041

SEQ ID NO: 65480 - protein, 100 aa, Homo sapiens
  Payload ID: 13028
  Gene Symbol: KCTD1
  Gene Name: potassium channel tetramerization domain containing 1
  ENSP ID: ENSP00000463608
MSRPLITRSPASPLNNQGIPTPAQLTKSNAPVHIDVGGHMYTSSLATLTKYPESRTTLCYMKRQNIFSFSPCCWRWKDGSRTEKLVDFQGPVSASSCVWP

SEQ ID NO: 65481 - protein, 257 aa, Homo sapiens; identical to SEQ ID NO: 65475
  Payload ID: 13028
  Gene Symbol: KCTD1
  Gene Name: potassium channel tetramerization domain containing 1
  Uniprot ID: Q719H9
  ENSP ID: ENSP00000464170

SEQ ID NO: 65482 - protein, 260 aa, Homo sapiens
  Payload ID: 13028
  Gene Symbol: KCTD1
  Gene Name: potassium channel tetramerization domain containing 1
  ENSP ID: ENSP00000464261
MFQDSRPNMSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIK

SEQ ID NO: 65483 - protein, 313 aa, Homo sapiens
  Payload ID: 13029
  Gene Symbol: KCTD10
  Gene Name: potassium channel tetramerization domain containing 10
  Uniprot ID: Q9H3F6
  ENSP ID: ENSP00000228495
MEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 65484 - protein, 77 aa, Homo sapiens
  Payload ID: 13029
  Gene Symbol: KCTD10
  Gene Name: potassium channel tetramerization domain containing 10
  ENSP ID: ENSP00000390321
MEEMSGESVVSSAVPAAATRTTSFKGTSPSSKYVKLNVGGALYYTTMQTLTKQDTMLKAMFSGRMEVLTDSEEQRYL

SEQ ID NO: 65485 - protein, 170 aa, Homo sapiens
  Payload ID: 13029
  Gene Symbol: KCTD10
  Gene Name: potassium channel tetramerization domain containing 10
  ENSP ID: ENSP00000437348
MEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQPAVKLLYNRSNNKYSYTSNSDDNMLKNIELFDKLSLRFNGR

SEQ ID NO: 65486 - protein, 121 aa, Homo sapiens
  Payload ID: 13029
  Gene Symbol: KCTD10
  Gene Name: potassium channel tetramerization domain containing 10
  ENSP ID: ENSP00000439481
MLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHI

SEQ ID NO: 65487 - protein, 132 aa, Homo sapiens
  Payload ID: 13029
  Gene Symbol: KCTD10
  Gene Name: potassium channel tetramerization domain containing 10
  ENSP ID: ENSP00000439722
MLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 65488 - protein, 104 aa, Homo sapiens
  Payload ID: 13029
  Gene Symbol: KCTD10
  Gene Name: potassium channel tetramerization domain containing 10
  ENSP ID: ENSP00000440008
MLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHL

SEQ ID NO: 65489 - protein, 120 aa, Homo sapiens
  Payload ID: 13029
  Gene Symbol: KCTD10
  Gene Name: potassium channel tetramerization domain containing 10
  ENSP ID: ENSP00000441586
MLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIH

SEQ ID NO: 65490 - protein, 287 aa, Homo sapiens
  Payload ID: 13029
  Gene Symbol: KCTD10
  Gene Name: potassium channel tetramerization domain containing 10
  ENSP ID: ENSP00000441672
MSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 65491 - protein, 175 aa, Homo sapiens
  Payload ID: 13029
  Gene Symbol: KCTD10
  Gene Name: potassium channel tetramerization domain containing 10
  ENSP ID: ENSP00000445129
MEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQVPVITSSKEEQKLIATSNKPAVKLLYNRSNNKYSYTSNSDDNMLKN

SEQ ID NO: 65492 - protein, 64 aa, Homo sapiens
  Payload ID: 13029
  Gene Symbol: KCTD10
  Gene Name: potassium channel tetramerization domain containing 10
  ENSP ID: ENSP00000474497
MGPDMAGDIQATVGCHGVGESWPEELDNLELNIVHDCRVASAVASCLPLLPVPFTKITFVFYQL

SEQ ID NO: 65493 - protein, 37 aa, Homo sapiens
  Payload ID: 13029
  Gene Symbol: KCTD10
  Gene Name: potassium channel tetramerization domain containing 10
  ENSP ID: ENSP00000474870
MAGSSLTAVGSTLVRYSTTFETGRCLYPRAAGRSRSC

SEQ ID NO: 65494 - protein, 232 aa, Homo sapiens
  Payload ID: 13030
  Gene Symbol: KCTD11
  Gene Name: potassium channel tetramerization domain containing 11
  Uniprot ID: Q693B1
  ENSP ID: ENSP00000328352
MLGAMFRAGTPMPPNLNSQGGGHYFIDRDGKAFRHILNFLRLGRLDLPRGYGETALLRAEADFYQIRPLLDALRELEASQGTPAPTAALLHADVDVSPRLVHFSARRGPHHYELSSVQVDTFRANLFCTDSECLGALRARFGVASGDRAEGSPHFHLEWAPRPVELPEVEYGRLGLQPLWTGGPGERREVVGTPSFLEEVLRVALEHGFRLDSVFPDPEDLLNSRSLRFVRH

SEQ ID NO: 65495 - protein, 325 aa, Homo sapiens
  Payload ID: 13031
  Gene Symbol: KCTD12
  Gene Name: potassium channel tetramerization domain containing 12
  Uniprot ID: Q96CX2
  ENSP ID: ENSP00000366694
MALADSTRGLPNGGGGGGGSGSSSSSAEPPLFPDIVELNVGGQVYVTRRCTVVSVPDSLLWRMFTQQQPQELARDSKGRFFLDRDGFLFRYILDYLRDLQLVLPDYFPERSRLQREAEYFELPELVRRLGAPQQPGPGPPPSRRGVHKEGSLGDELLPLGYSEPEQQEGASAGAPSPTLELASRSPSGGAAGPLLTPSQSLDGSRRSGYITIGYRGSYTIGRDAQADAKFRRVARITVCGKTSLAKEVFGDTLNESRDPDRPPERYTSRYYLKFNFLEQAFDKLSESGFHMVACSSTGTCAFASSTDQSEDKIWTSYTEYVFCRE

SEQ ID NO: 65496 - protein, 329 aa, Homo sapiens
  Payload ID: 13032
  Gene Symbol: KCTD13
  Gene Name: potassium channel tetramerization domain containing 13
  Uniprot ID: Q8WZ19
  ENSP ID: ENSP00000311202
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 65497 - protein, 140 aa, Homo sapiens
  Payload ID: 13032
  Gene Symbol: KCTD13
  Gene Name: potassium channel tetramerization domain containing 13
  ENSP ID: ENSP00000454282
YYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKCIVHAKVCGPS

SEQ ID NO: 65498 - protein, 329 aa, Homo sapiens; identical to SEQ ID NO: 65496
  Payload ID: 13032
  Gene Symbol: KCTD13
  Gene Name: potassium channel tetramerization domain containing 13
  Uniprot ID: Q8WZ19
  ENSP ID: ENSP00000455785

SEQ ID NO: 65499 - protein, 209 aa, Homo sapiens
  Payload ID: 13032
  Gene Symbol: KCTD13
  Gene Name: potassium channel tetramerization domain containing 13
  ENSP ID: ENSP00000458486
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQVRAFGVPMPMFLGELPKQVLEQKKGDMGYGLESLALAGHNPREFEVPSSASLPPQAAPPPQPHARTFAMVK

SEQ ID NO: 65500 - protein, 120 aa, Homo sapiens
  Payload ID: 13032
  Gene Symbol: KCTD13
  Gene Name: potassium channel tetramerization domain containing 13
  ENSP ID: ENSP00000459104
KAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTR

SEQ ID NO: 65501 - protein, 81 aa, Homo sapiens
  Payload ID: 13032
  Gene Symbol: KCTD13
  Gene Name: potassium channel tetramerization domain containing 13
  ENSP ID: ENSP00000460526
  MOD_RES (1)..(1): Any amino acid
XILNYLRDGSVPLPESTRELGELLGEARYYLVQGLIEDCQLALQSRAYSGFSSCSRNVFLQLVHQTRVQSRSSRCIWLSAS

SEQ ID NO: 65502 - protein, 255 aa, Homo sapiens
  Payload ID: 13033
  Gene Symbol: KCTD14
  Gene Name: potassium channel tetramerization domain containing 14
  Uniprot ID: Q9BQ13
  ENSP ID: ENSP00000316482
MWQGCAVERPVGRMTSQTPLPQSPRPRRPTMSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 65503 - protein, 225 aa, Homo sapiens
  Payload ID: 13033
  Gene Symbol: KCTD14
  Gene Name: potassium channel tetramerization domain containing 14
  Uniprot ID: Q9BQ13
  ENSP ID: ENSP00000431155
MSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 65504 - protein, 234 aa, Homo sapiens
  Payload ID: 13034
  Gene Symbol: KCTD15
  Gene Name: potassium channel tetramerization domain containing 15
  Uniprot ID: Q96SI1
  ENSP ID: ENSP00000284006
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQDVL

SEQ ID NO: 65505 - protein, 283 aa, Homo sapiens
  Payload ID: 13034
  Gene Symbol: KCTD15
  Gene Name: potassium channel tetramerization domain containing 15
  Uniprot ID: Q96SI1
  ENSP ID: ENSP00000394390
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVLERLFQRGFSVAASCGGGVDSSQFSEYVLCREERRPQPTPTAVRIKQEPLD

SEQ ID NO: 65506 - protein, 61 aa, Homo sapiens
  Payload ID: 13034
  Gene Symbol: KCTD15
  Gene Name: potassium channel tetramerization domain containing 15
  ENSP ID: ENSP00000464722
MPHRKERPSGSSLHTHGSTGTAEGGNMSRLSLTRSPVSPLAAQGIPLPAQLTKSNAPVHID

SEQ ID NO: 65507 - protein, 283 aa, Homo sapiens; identical to SEQ ID NO: 65505
  Payload ID: 13034
  Gene Symbol: KCTD15
  Gene Name: potassium channel tetramerization domain containing 15
  Uniprot ID: Q96SI1
  ENSP ID: ENSP00000464812

SEQ ID NO: 65508 - protein, 112 aa, Homo sapiens
  Payload ID: 13034
  Gene Symbol: KCTD15
  Gene Name: potassium channel tetramerization domain containing 15
  ENSP ID: ENSP00000466357
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRY

SEQ ID NO: 65509 - protein, 128 aa, Homo sapiens
  Payload ID: 13034
  Gene Symbol: KCTD15
  Gene Name: potassium channel tetramerization domain containing 15
  ENSP ID: ENSP00000466804
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDF

SEQ ID NO: 65510 - protein, 77 aa, Homo sapiens
  Payload ID: 13034
  Gene Symbol: KCTD15
  Gene Name: potassium channel tetramerization domain containing 15
  ENSP ID: ENSP00000467353
MPHRKERPSGSSLHTHGSTGTAEGGNMSRLSLTRSPVSPLAAQGIPLPAQLTKSNAPVHIDVGGHMYTSSLATLTKY

SEQ ID NO: 65511 - protein, 283 aa, Homo sapiens; identical to SEQ ID NO: 65505
  Payload ID: 13034
  Gene Symbol: KCTD15
  Gene Name: potassium channel tetramerization domain containing 15
  Uniprot ID: Q96SI1
  ENSP ID: ENSP00000467612

SEQ ID NO: 65512 - protein, 82 aa, Homo sapiens
  Payload ID: 13034
  Gene Symbol: KCTD15
  Gene Name: potassium channel tetramerization domain containing 15
  ENSP ID: ENSP00000467955
MPHRKERPSGSSLHTHGSTGTAEGGNMSRLSLTRSPVSPLAAQGIPLPAQLTKSNAPVHIDVGGHMYTSSLATLTKYPDSRI

SEQ ID NO: 65513 - protein, 163 aa, Homo sapiens
  Payload ID: 13034
  Gene Symbol: KCTD15
  Gene Name: potassium channel tetramerization domain containing 15
  ENSP ID: ENSP00000477220
FIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVRAARCPLPAAPPASAEPSRGRVSWREARSLKR

SEQ ID NO: 65514 - protein, 428 aa, Homo sapiens
  Payload ID: 13035
  Gene Symbol: KCTD16
  Gene Name: potassium channel tetramerization domain containing 16
  Uniprot ID: Q68DU8
  ENSP ID: ENSP00000424151
MALSGNCSRYYPREQGSAVPNSFPEVVELNVGGQVYFTRHSTLISIPHSLLWKMFSPKRDTANDLAKDSKGRFFIDRDGFLFRYILDYLRDRQVVLPDHFPEKGRLKREAEYFQLPDLVKLLTPDEIKQSPDEFCHSDFEDASQGSDTRICPPSSLLPADRKWGFITVGYRGSCTLGREGQADAKFRRVPRILVCGRISLAKEVFGETLNESRDPDRAPERYTSRFYLKFKHLERAFDMLSECGFHMVACNSSVTASFINQYTDDKIWSSYTEYVFYREPSRWSPSHCDCCCKNGKGDKEGESGTSCNDLSTSSCDSQSEASSPQETVICGPVTRQTNIQTLDRPIKKGPVQLIQQSEMRRKSDLLRTLTSGSRESNMSSKKKAVKEKLSIEEELEKCIQDFLKIKIPDRFPERKHPWQSELLRKYHL

SEQ ID NO: 65515 - protein, 428 aa, Homo sapiens; identical to SEQ ID NO: 65514
  Payload ID: 13035
  Gene Symbol: KCTD16
  Gene Name: potassium channel tetramerization domain containing 16
  Uniprot ID: Q68DU8
  ENSP ID: ENSP00000426548

SEQ ID NO: 65516 - protein, 297 aa, Homo sapiens
  Payload ID: 13036
  Gene Symbol: KCTD17
  Gene Name: potassium channel tetramerization domain containing 17
  Uniprot ID: Q8N5Z5
  ENSP ID: ENSP00000384391
MQTPRPAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGSRPHPLRPEAELAVRASPRPLARPQSCHPCCYKPEAPGCEAPDHLQGLGVPI

SEQ ID NO: 65517 - protein, 321 aa, Homo sapiens
  Payload ID: 13036
  Gene Symbol: KCTD17
  Gene Name: potassium channel tetramerization domain containing 17
  Uniprot ID: Q8N5Z5
  ENSP ID: ENSP00000385096
MQTPRPAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKAQSSQDPANLFSLPPLPPPPLPAGGSRPHPLRPEAELAVRASPRPLARPQSCHPCCYKPEAPGCEAPDHLQGLGVPI

SEQ ID NO: 65518 - protein, 63 aa, Homo sapiens
  Payload ID: 13036
  Gene Symbol: KCTD17
  Gene Name: potassium channel tetramerization domain containing 17
  ENSP ID: ENSP00000402434
MTSKVSCPPSVTLRCCGLWQVASPLNVSDLSDETGAYLIDRDPTYFGPILNFLRHGKLVLDKD

SEQ ID NO: 65519 - protein, 104 aa, Homo sapiens
  Payload ID: 13036
  Gene Symbol: KCTD17
  Gene Name: potassium channel tetramerization domain containing 17
  ENSP ID: ENSP00000409116
  MOD_RES (1)..(1): Any amino acid
XGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPSM

SEQ ID NO: 65520 - protein, 180 aa, Homo sapiens
  Payload ID: 13036
  Gene Symbol: KCTD17
  Gene Name: potassium channel tetramerization domain containing 17
  ENSP ID: ENSP00000409638
  MOD_RES (1)..(1): Any amino acid
XQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKVPVRTLSDLRLSLQ

SEQ ID NO: 65521 - protein, 220 aa, Homo sapiens
  Payload ID: 13036
  Gene Symbol: KCTD17
  Gene Name: potassium channel tetramerization domain containing 17
  ENSP ID: ENSP00000480699
MQTPRPAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKLLQARGTRM

SEQ ID NO: 65522 - protein, 426 aa, Homo sapiens
  Payload ID: 13037
  Gene Symbol: KCTD18
  Gene Name: potassium channel tetramerization domain containing 18
  Uniprot ID: Q6PI47
  ENSP ID: ENSP00000352941
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSLRSNIELKKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 65523 - protein, 426 aa, Homo sapiens; identical to SEQ ID NO: 65522
  Payload ID: 13037
  Gene Symbol: KCTD18
  Gene Name: potassium channel tetramerization domain containing 18
  Uniprot ID: Q6PI47
  ENSP ID: ENSP00000386751

SEQ ID NO: 65524 - protein, 926 aa, Homo sapiens
  Payload ID: 13038
  Gene Symbol: KCTD19
  Gene Name: potassium channel tetramerization domain containing 19
  Uniprot ID: Q17RG1
  ENSP ID: ENSP00000305702
MEESGMAHESAEDLFHFNVGGWHFSVPRSKLSQFPDSLLWKEASALTSSESQRLFIDRDGSTFRHVHYYLYTSKLSFSSCAELNLLYEQALGLQLMPLLQTLDNLKEGKHHLRVRPADLPVAERASLNYWRTWKCISKPSEFPIKSPAFTGLHDKAPLGLMDTPLLDTEEEVHYCFLPLDLVAKYPSLVTEDNLLWLAETVALIECECSEFRFIVNFLRSQKILLPDNFSNIDVLEAEVEILEIPALTEAVRWYRMNMGGCSPTTCSPLSPGKGARTASLESVKPLYTMALGLLVKYPDSALGQLRIESTLDGSRLYITGNGVLFQHVKNWLGTCRLPLTETISEVYELCAFLDKRDITYEPIKVALKTHLEPRTLAPMDVLNEWTAEITVYSPQQIIKVYVGSHWYATTLQTLLKYPELLSNPQRVYWITYGQTLLIHGDGQMFRHILNFLRLGKLFLPSEFKEWPLFCQEVEEYHIPSLSEALAQCEAYKSWTQEKESENEEAFSIRRLHVVTEGPGSLVEFSRDTKETTAYMPVDFEDCSDRTPWNKAKGNLVRSNQMDEAEQYTRPIQVSLCRNAKRAGNPSTYSHCRGLCTNPGHWGSHPESPPKKKCTTINLTQKSETKDPPATPMQKLISLVREWDMVNCKQWEFQPLTATRSSPLEEATLQLPLGSEAASQPSTSAAWKAHSTASEKDPGPQAGAGAGAKDKGPEPTFKPYLPPKRAGTLKDWSKQRTKERESPAPEQPLPEASEVDSLGVILKVTHPPVVGSDGFCMFFEDSIIYTTEMDNLRHTTPTASPQPQEVTFLSFSLSWEEMFYAQKCHCFLADIIMDSIRQKDPKAITAKVVSLANRLWTLHISPKQFVVDLLAITGFKDDRHTQERLYSWVELTLPFARKYGRCMDLLIQRGLSRSVSYSILGKYLQED

SEQ ID NO: 65525 - protein, 134 aa, Homo sapiens
  Payload ID: 13038
  Gene Symbol: KCTD19
  Gene Name: potassium channel tetramerization domain containing 19
  ENSP ID: ENSP00000458045
MAHESAEDLFHFNVGGWHFSVPRSKLSQFPDSLLWKEASALTSSESQRLFIDRDGSTFRHVHYYLYTSKLSFSSCAELNLLYEQALGLQLMPLLQTLDNLKEGKHHLRVRPADLPVAERASLNYWRTWKCISKP

SEQ ID NO: 65526 - protein, 46 aa, Homo sapiens
  Payload ID: 13038
  Gene Symbol: KCTD19
  Gene Name: potassium channel tetramerization domain containing 19
  ENSP ID: ENSP00000462122
MVRSPLWRGRQKHQSGEWGPLWPRIGAKWRSLAWLMNQQRTCFIST

SEQ ID NO: 65527 - protein, 76 aa, Homo sapiens
  Payload ID: 13038
  Gene Symbol: KCTD19
  Gene Name: potassium channel tetramerization domain containing 19
  ENSP ID: ENSP00000462732
MAHESAEDLFHFNVGGWHFSVPRSKLSQFPDSLLWKEASALTSSESQRLFIDRDGSTFRHVHYYLYTSKLSFSSCA

SEQ ID NO: 65528 - protein, 115 aa, Homo sapiens
  Payload ID: 13038
  Gene Symbol: KCTD19
  Gene Name: potassium channel tetramerization domain containing 19
  ENSP ID: ENSP00000463249
CKQWEFQPLTATRSSPLEEATLQLPLGSEAASQPSTSAAWKAHSTASEKDPGPQAGAGAGAKDKGPEPTFKPYLPPKRAGTLKDWSKQRTKERAYTALRQEIWPMHGPAHPEGPV

SEQ ID NO: 65529 - protein, 263 aa, Homo sapiens
  Payload ID: 13039
  Gene Symbol: KCTD2
  Gene Name: potassium channel tetramerization domain containing 2
  Uniprot ID: Q14681
  ENSP ID: ENSP00000312814
MAELQLDPAMAGLGGGGGSGVGDGGGPVRGPPSPRPAGPTPRGHGRPAAAVAQPLEPGPGPPERAGGGGAARWVRLNVGGTYFVTTRQTLGREPKSFLCRLCCQEDPELDSDKDETGAYLIDRDPTYFGPILNYLRHGKLIITKELAEEGVLEEAEFYNIASLVRLVKERIRDNENRTSQGPVKHVYRVLQCQEEELTQMVSTMSDGWKFEQLISIGSSYNYGNEDQAEFLCVVSRELNNSTNGIVIEPSEKAKILQERGSRM

SEQ ID NO: 65530 - protein, 74 aa, Homo sapiens
  Payload ID: 13039
  Gene Symbol: KCTD2
  Gene Name: potassium channel tetramerization domain containing 2
  ENSP ID: ENSP00000364435
MAELQLDPAMAGLGGGAGSRTTRAGRGRRRGPLGQAERGRHLLRDHQTDLRPGAQVISLPPLLPGGPGAGLRQG

SEQ ID NO: 65531 - protein, 64 aa, Homo sapiens
  Payload ID: 13039
  Gene Symbol: KCTD2
  Gene Name: potassium channel tetramerization domain containing 2
  ENSP ID: ENSP00000464630
MVSTMSDGWKFEQLISIGSSYNYGNEDQAEFLCVVSRELNNSTNGIVIEPSEKAKILQERGSRM

SEQ ID NO: 65532 - protein, 127 aa, Homo sapiens
  Payload ID: 13040
  Gene Symbol: KCTD20
  Gene Name: potassium channel tetramerization domain containing 20
  ENSP ID: ENSP00000265344
MNVHRGSDSDRLLRQEASCLVDDTLAVAQEKEANSLASSGPHNLTYPLGPRNEGCLDQEESTTSLGPMRRESMRLLKASVQLYFAQCWIITKPVSSIVLMASLSQILEILVIISALILTSTLSDVKI

SEQ ID NO: 65533 - protein, 419 aa, Homo sapiens
  Payload ID: 13040
  Gene Symbol: KCTD20
  Gene Name: potassium channel tetramerization domain containing 20
  Uniprot ID: Q7Z5Y7
  ENSP ID: ENSP00000362836
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAPERFGNSSVGFGSNSHSQAPEKVTLLVDGTRFVVNPQIFTAHPDTMLGRMFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 65534 - protein, 253 aa, Homo sapiens
  Payload ID: 13040
  Gene Symbol: KCTD20
  Gene Name: potassium channel tetramerization domain containing 20
  Uniprot ID: Q7Z5Y7
  ENSP ID: ENSP00000412205
MNVHRGSDSDRLLRQEASCLVDDTLAVAQEKEANSLASSGPHNLTYPLGPRNEGALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 65535 - protein, 87 aa, Homo sapiens
  Payload ID: 13040
  Gene Symbol: KCTD20
  Gene Name: potassium channel tetramerization domain containing 20
  ENSP ID: ENSP00000417126
MNVHRGSDSDRLLRQEASCLVDDTLAVAQEKEANSLASSGPHNLTYPLGPRNEDLSLDYASQPANLQFPHIMPLAEDIKGSCFQSGN

SEQ ID NO: 65536 - protein, 97 aa, Homo sapiens
  Payload ID: 13040
  Gene Symbol: KCTD20
  Gene Name: potassium channel tetramerization domain containing 20
  ENSP ID: ENSP00000418459
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAP

SEQ ID NO: 65537 - protein, 92 aa, Homo sapiens
  Payload ID: 13040
  Gene Symbol: KCTD20
  Gene Name: potassium channel tetramerization domain containing 20
  ENSP ID: ENSP00000419118
MNVHRGSDSDRLLRQEASCLVDDTLAVAQEKEANSLASSGPHNLTYPLGPRNEGCLDQEESTTSLGPMRRESMRLLKASVQLYFAQCWCFTP

SEQ ID NO: 65538 - protein, 109 aa, Homo sapiens
  Payload ID: 13040
  Gene Symbol: KCTD20
  Gene Name: potassium channel tetramerization domain containing 20
  ENSP ID: ENSP00000419943
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAPERFGNSSVGFGS

SEQ ID NO: 65539 - protein, 274 aa, Homo sapiens
  Payload ID: 13040
  Gene Symbol: KCTD20
  Gene Name: potassium channel tetramerization domain containing 20
  Uniprot ID: Q7Z5Y7
  ENSP ID: ENSP00000439118
MFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 65540 - protein, 260 aa, Homo sapiens
  Payload ID: 13041
  Gene Symbol: KCTD21
  Gene Name: potassium channel tetramerization domain containing 21
  Uniprot ID: Q4G0X4
  ENSP ID: ENSP00000339340
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFYCSNGNLSSITSHLQDPNHLTLDWVANVEGLPEEEYTKQNLKRLWVVPANKQINSFQVFVEEVLKIALSDGFCIDSSHPHALDFMNNKIIRLIRYR

SEQ ID NO: 65541 - protein, 115 aa, Homo sapiens
  Payload ID: 13041
  Gene Symbol: KCTD21
  Gene Name: potassium channel tetramerization domain containing 21
  ENSP ID: ENSP00000431130
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNIT

SEQ ID NO: 65542 - protein, 165 aa, Homo sapiens
  Payload ID: 13041
  Gene Symbol: KCTD21
  Gene Name: potassium channel tetramerization domain containing 21
  ENSP ID: ENSP00000431789
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFY

SEQ ID NO: 65543 - protein, 140 aa, Homo sapiens
  Payload ID: 13041
  Gene Symbol: KCTD21
  Gene Name: potassium channel tetramerization domain containing 21
  ENSP ID: ENSP00000434174
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSS

SEQ ID NO: 65544 - protein, 37 aa, Homo sapiens
  Payload ID: 13041
  Gene Symbol: KCTD21
  Gene Name: potassium channel tetramerization domain containing 21
  ENSP ID: ENSP00000435025
MSDPITLNVGGKLYTTSLATLTSFPDSMLGAMFSGKM

SEQ ID NO: 65545 - protein, 71 aa, Homo sapiens
  Payload ID: 13041
  Gene Symbol: KCTD21
  Gene Name: potassium channel tetramerization domain containing 21
  ENSP ID: ENSP00000435428
MSDPITLNVGGKLYTTSLATLTSFPDSMLGAMFSGKMPTKRDSQGNCFIDRDGKVFRYILNFLRTSHLDLP

SEQ ID NO: 65546 - protein, 815 aa, Homo sapiens
  Payload ID: 13042
  Gene Symbol: KCTD3
  Gene Name: potassium channel tetramerization domain containing 3
  Uniprot ID: Q9Y597
  ENSP ID: ENSP00000259154
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRIKESSGWQQVFTSPYLDWTIERVALNAKVVGGPHGDKDKMVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 65547 - protein, 213 aa, Homo sapiens
  Payload ID: 13042
  Gene Symbol: KCTD3
  Gene Name: potassium channel tetramerization domain containing 3
  ENSP ID: ENSP00000396726
  MOD_RES (1)..(1): Any amino acid
XFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRVFWLGTVGHACNPSTLGGRDGWSSRSARPTW

SEQ ID NO: 65548 - protein, 168 aa, Homo sapiens
  Payload ID: 13042
  Gene Symbol: KCTD3
  Gene Name: potassium channel tetramerization domain containing 3
  ENSP ID: ENSP00000399962
  MOD_RES (1)..(1): Any amino acid
XALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKSLCGVSLVSRSSQEPT

SEQ ID NO: 65549 - protein, 259 aa, Homo sapiens
  Payload ID: 13043
  Gene Symbol: KCTD4
  Gene Name: potassium channel tetramerization domain containing 4
  Uniprot ID: Q8WVF5
  ENSP ID: ENSP00000368402
MERKINRREKEKEYEGKHNSLEDTDQGKNCKSTLMTLNVGGYLYITQKQTLTKYPDTFLEGIVNGKILCPFDADGHYFIDRDGLLFRHVLNFLRNGELLLPEGFRENQLLAQEAEFFQLKGLAEEVKSRWEKEQLTPRETTFLEITDNHDRSQGLRIFCNAPDFISKIKSRIVLVSKSRLDGFPEEFSISSNIIQFKYFIKSENGTRLVLKEDNTFVCTLETLKFEAIMMALKCGFRLLTSLDCSKGSIVHSDALHFIK

SEQ ID NO: 65550 - protein, 234 aa, Homo sapiens
  Payload ID: 13044
  Gene Symbol: KCTD5
  Gene Name: potassium channel tetramerization domain containing 5
  Uniprot ID: Q9NXV2
  ENSP ID: ENSP00000301738
MAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGVLEEAEFYNITSLIKLVKDKIRERDSKTSQVPVKHVYRVLQCQEEELTQMVSTMSDGWKFEQLVSIGSSYNYGNEDQAEFLCVVSKELHNTPYGTASEPSEKAKILQERGSRM

SEQ ID NO: 65551 - protein, 246 aa, Homo sapiens
  Payload ID: 13044
  Gene Symbol: KCTD5
  Gene Name: potassium channel tetramerization domain containing 5
  ENSP ID: ENSP00000456844
MAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGACEACVPCAAVPGGGAHADGVHHVRRLEVRAVGQHRLLLQLWERRPSRVPLCGVQGAAQHPVRYGQRAQREGQDFARTRLKDVRDTVLTAEEMIYVFPRCNELPCPGSLAVRRNLLLIIFLEIWV

SEQ ID NO: 65552 - protein, 237 aa, Homo sapiens
  Payload ID: 13045
  Gene Symbol: KCTD6
  Gene Name: potassium channel tetramerization domain containing 6
  Uniprot ID: Q8NC69
  ENSP ID: ENSP00000347188
MDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLARKTDD

SEQ ID NO: 65553 - protein, 237 aa, Homo sapiens; identical to SEQ ID NO: 65552
  Payload ID: 13045
  Gene Symbol: KCTD6
  Gene Name: potassium channel tetramerization domain containing 6
  Uniprot ID: Q8NC69
  ENSP ID: ENSP00000384948

SEQ ID NO: 65554 - protein, 237 aa, Homo sapiens; identical to SEQ ID NO: 65552
  Payload ID: 13045
  Gene Symbol: KCTD6
  Gene Name: potassium channel tetramerization domain containing 6
  Uniprot ID: Q8NC69
  ENSP ID: ENSP00000417490

SEQ ID NO: 65555 - protein, 9 aa, Homo sapiens
  Payload ID: 13045
  Gene Symbol: KCTD6
  Gene Name: potassium channel tetramerization domain containing 6
  ENSP ID: ENSP00000418999
MDNGDWGYM

SEQ ID NO: 65556 - protein, 74 aa, Homo sapiens
  Payload ID: 13045
  Gene Symbol: KCTD6
  Gene Name: potassium channel tetramerization domain containing 6
  ENSP ID: ENSP00000442507
MTDPVTLNVGGHLYTTSLTTLTRYPDSMLGAMFGGDFPTARDPQGNYFIDRDGPLFRYVLNFLRTSELTLPLDF

SEQ ID NO: 65557 - protein, 289 aa, Homo sapiens
  Payload ID: 13046
  Gene Symbol: KCTD7
  Gene Name: potassium channel tetramerization domain containing 7
  Uniprot ID: Q96MP8
  ENSP ID: ENSP00000275532
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 65558 - protein, 132 aa, Homo sapiens
  Payload ID: 13046
  Gene Symbol: KCTD7
  Gene Name: potassium channel tetramerization domain containing 7
  ENSP ID: ENSP00000388463
MVVVTGREPDSRRQDGAMSSSDAEDDFLEPATPTATQAGHALPLLPQERCAEFPALRGPPTQGACSSCVQRGPVLCHRAPPGAAGEHAATEGREGAPSVSGTHALLQRPLGADCGDRPAACGPAEGPLCQAQ

SEQ ID NO: 65559 - protein, 288 aa, Homo sapiens
  Payload ID: 13046
  Gene Symbol: KCTD7
  Gene Name: potassium channel tetramerization domain containing 7
  Uniprot ID: Q96MP8
  ENSP ID: ENSP00000411624
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITW

SEQ ID NO: 65560 - protein, 232 aa, Homo sapiens
  Payload ID: 13046
  Gene Symbol: KCTD7
  Gene Name: potassium channel tetramerization domain containing 7
  ENSP ID: ENSP00000421074
MVVVTGREPDSRRQDGAMSSSDAEDDFLEPATPTATQAGHALPLLPQERCAEFPALRGPPTQGACSSCVQRGPVLCHRAPPGAAGEHAATEGREGAPSVSGTHALLQRPLGADCGDRPAACGPAEGPLCQAQVVSRKKMSLKSERRGIHVDQSDLLCKKGCGYYGNPAWQGFCSKCWREEYHKARQKQIQEDWELAERVLLCYPGWSAMVQFQLTATSASWAQVILLLQPPK

SEQ ID NO: 65561 - protein, 473 aa, Homo sapiens
  Payload ID: 13047
  Gene Symbol: KCTD8
  Gene Name: potassium channel tetramerization domain containing 8
  Uniprot ID: Q6ZWB6
  ENSP ID: ENSP00000353129
MALKDTGSGGSTILPISEMVSSSSSPGASAAAAPGPCAPSPFPEVVELNVGGQVYVTKHSTLLSVPDSTLASMFSPSSPRGGARRRGELPRDSRARFFIDRDGFLFRYVLDYLRDKQLALPEHFPEKERLLREAEYFQLTDLVKLLSPKVTKQNSLNDEGCQSDLEDNVSQGSSDALLLRGAAAAVPSGPGAHGGGGGGGAQDKRSGFLTLGYRGSYTTVRDNQADAKFRRVARIMVCGRIALAKEVFGDTLNESRDPDRQPEKYTSRFYLKFTYLEQAFDRLSEAGFHMVACNSSGTAAFVNQYRDDKIWSSYTEYIFFRPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISKSRETNLSKKKVCEKLSVEEEMKKCIQDFKKIHIPDYFPERKRQWQSELLQKYGL

SEQ ID NO: 65562 - protein, 155 aa, Homo sapiens
  Payload ID: 13047
  Gene Symbol: KCTD8
  Gene Name: potassium channel tetramerization domain containing 8
  ENSP ID: ENSP00000424862
  MOD_RES (1)..(1): Any amino acid
XYRDDKIWSSYTEYIFFRSLTMSLCSILRLNIWLFMIACQIKHESRCRTRARCLAAGPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISK

SEQ ID NO: 65563 - protein, 389 aa, Homo sapiens
  Payload ID: 13048
  Gene Symbol: KCTD9
  Gene Name: potassium channel tetramerization domain containing 9
  Uniprot ID: Q7L273
  ENSP ID: ENSP00000221200
MRRVTLFLNGSPKNGKVVAVYGTLSDLLSVASSKLGIKATSVYNGKGGLIDDIALIRDDDVLFVCEGEPFIDPQTDSKPPEGLLGFHTDWLTLNVGGRYFTTTRSTLVNKEPDSMLAHMFKDKGVWGNKQDHRGAFLIDRSPEYFEPILNYLRHGQLIVNDGINLLGVLEEARFFGIDSLIEHLEVAIKNSQPPEDHSPISRKEFVRFLLATPTKSELRCQGLNFSGADLSRLDLRYINFKMANLSRCNLAHANLCCANLERADLSGSVLDCANLQGVKMLCSNAEGASLKLCNFEDPSGLKANLEGANLKGVDMEGSQMTGINLRVATLKNAKLKNCNLRGATLAGTDLENCDLSGCDLQEANLRGSNVKGAIFEEMLTPLHMSQSVR

SEQ ID NO: 65564 - protein, 57 aa, Homo sapiens
  Payload ID: 13048
  Gene Symbol: KCTD9
  Gene Name: potassium channel tetramerization domain containing 9
  ENSP ID: ENSP00000466874
MRRVTLFLNGSPKNGKVVAVYGTLSDLLSVASSKLGIKATSVYNGKGGLIDDIALIR

SEQ ID NO: 65565 - protein, 62 aa, Homo sapiens
  Payload ID: 13048
  Gene Symbol: KCTD9
  Gene Name: potassium channel tetramerization domain containing 9
  ENSP ID: ENSP00000467904
MRRVTLFLNGSPKNGKVVAVYGTLSDLLSVASSKLGIKATSVYNGKGGLIDDIALIRSSDRF

SEQ ID NO: 65566 - protein, 543 aa, Homo sapiens
  Payload ID: 13049
  Gene Symbol: KCNN1
  Gene Name: potassium channel, calcium activated intermediate/small conductance subfamily N alpha, member 1
  Uniprot ID: Q92952
  ENSP ID: ENSP00000476519
MNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQAQKLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 65567 - protein, 158 aa, Homo sapiens
  Payload ID: 13049
  Gene Symbol: KCNN1
  Gene Name: potassium channel, calcium activated intermediate/small conductance subfamily N alpha, member 1
  ENSP ID: ENSP00000477114
MRLPPPPPAPPPPGPAPARCCPPRPRPRLRLPTGGPRPRGTLSPPALSARSGRAPQVSAGAQPLSHAGPRAACSEPNPCTQVVMNSHSYNGSVGRPLGSGPGALGRDPPDPEAGHPPQPPHSPGLQVVVAKSEPARPSPGSPRGQPQDQDDDEDDEED

SEQ ID NO: 65568 - protein, 543 aa, Homo sapiens
  Payload ID: 13049
  Gene Symbol: KCNN1
  Gene Name: potassium channel, calcium activated intermediate/small conductance subfamily N alpha, member 1
  ENSP ID: ENSP00000484926
MNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQVQRLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 65569 - protein, 579 aa, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENSP ID: ENSP00000264773
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 65570 - protein, 95 aa, Homo sapiens
  Payload ID: 13050
  Gene Symbol: KCNN2
  Gene Name: potassium channel, calcium activated intermediate/small conductance subfamily N alpha, member 2
  ENSP ID: ENSP00000421095
MWLISITFLSIGYGDMVPNTYCGKGVCLLTGIMGAGCTALVVAVVARKLELTKAEKHVHNFMMDTQLTKRGKEDHGDNNCNTRWRTQHPLIKKKK

SEQ ID NO: 65571 - protein, 231 aa, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENSP ID: ENSP00000421439
MWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 65572 - protein, 579 aa, Homo sapiens; identical to SEQ ID NO: 65569
  Payload ID: 13050
  Gene Symbol: KCNN2
  Gene Name: potassium channel, calcium activated intermediate/small conductance subfamily N alpha, member 2
  Uniprot ID: Q9H2S1
  ENSP ID: ENSP00000427120

SEQ ID NO: 65573 - protein, 231 aa, Homo sapiens; identical to SEQ ID NO: 65571
  Payload ID: 13050
  Gene Symbol: KCNN2
  Gene Name: potassium channel, calcium activated intermediate/small conductance subfamily N alpha, member 2
  Uniprot ID: Q9H2S1
  ENSP ID: ENSP00000483124

SEQ ID NO: 65574 - protein, 582 aa, Homo sapiens
  Payload ID: 13050
  Gene Symbol: KCNN2
  Gene Name: potassium channel, calcium activated intermediate/small conductance subfamily N alpha, member 2
  ENSP ID: ENSP00000487849
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQARKLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 65575 - protein, 731 aa, Homo sapiens
  Payload ID: 13051
  Gene Symbol: KCNN3
  Gene Name: potassium channel, calcium activated intermediate/small conductance subfamily N alpha, member 3
  ENSP ID: ENSP00000271915
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 65576 - protein, 418 aa, Homo sapiens
  Payload ID: 13051
  Gene Symbol: KCNN3
  Gene Name: potassium channel, calcium activated intermediate/small conductance subfamily N alpha, member 3
  Uniprot ID: Q9UGI6
  ENSP ID: ENSP00000351295
MFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 65577 - protein, 426 aa, Homo sapiens
  Payload ID: 13051
  Gene Symbol: KCNN3
  Gene Name: potassium channel, calcium activated intermediate/small conductance subfamily N alpha, member 3
  Uniprot ID: Q9UGI6
  ENSP ID: ENSP00000354764
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 65578 - protein, 746 aa, Homo sapiens
  Payload ID: 13051
  Gene Symbol: KCNN3
  Gene Name: potassium channel, calcium activated intermediate/small conductance subfamily N alpha, member 3
  ENSP ID: ENSP00000481848
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCESPESPAQPSGSSLPAWYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 65579 - protein, 427 aa, Homo sapiens
  Payload ID: 13052
  Gene Symbol: KCNN4
  Gene Name: potassium channel, calcium activated intermediate/small conductance subfamily N alpha, member 4
  Uniprot ID: O15554
  ENSP ID: ENSP00000262888
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 65580 - protein, 59 aa, Homo sapiens
  Payload ID: 13052
  Gene Symbol: KCNN4
  Gene Name: potassium channel, calcium activated intermediate/small conductance subfamily N alpha, member 4
  ENSP ID: ENSP00000470339
VDISKMHMILYDLQQNLSSSHRALEKQIDTLAGKLDALTELLSTALGPRQLPEPSQQSK

SEQ ID NO: 65581 - protein, 165 aa, Homo sapiens
  Payload ID: 13052
  Gene Symbol: KCNN4
  Gene Name: potassium channel, calcium activated intermediate/small conductance subfamily N alpha, member 4
  ENSP ID: ENSP00000471900
  MOD_RES (1)..(1): Any amino acid
XVCCTALLVAVVARKLEFNKAEKHVHNFMMDIQYTKEEGVSCCPQASAQAAGRHQRVRAALYAHVSMCTHVQVTSLHGCVCACPCLSRFRQVRLKHRKLREQVNSMVDISKMHMILYDLQQNLSSSHRALEKQIDTLAGKLDALTELLSTALGPRQLPEPSQQSK

SEQ ID NO: 65582 - protein, 113 aa, Homo sapiens
  Payload ID: 13052
  Gene Symbol: KCNN4
  Gene Name: potassium channel, calcium activated intermediate/small conductance subfamily N alpha, member 4
  ENSP ID: ENSP00000472510
SDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINA

SEQ ID NO: 65583 - protein, 57 aa, Homo sapiens
  Payload ID: 13052
  Gene Symbol: KCNN4
  Gene Name: potassium channel, calcium activated intermediate/small conductance subfamily N alpha, member 4
  ENSP ID: ENSP00000472513
MGGDLVLGLGALRRRKRLLEQEKSLAGWALVLAGTGIGLMVLHAEMLWFGGCSTHFG

SEQ ID NO: 65584 - protein, 295 aa, Homo sapiens
  Payload ID: 13052
  Gene Symbol: KCNN4
  Gene Name: potassium channel, calcium activated intermediate/small conductance subfamily N alpha, member 4
  ENSP ID: ENSP00000485014
MHDQHFHLLTPLPHRGLSCQRGPAVHDRQRAAGLARGADRAAGNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 65585 - protein, 1178 aa, Homo sapiens
  Payload ID: 13053
  Gene Symbol: KCNMA1
  Gene Name: potassium channel, calcium activated large conductance subfamily M alpha, member 1
  Uniprot ID: Q12791
  ENSP ID: ENSP00000286627
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65586 - protein, 1236 aa, Homo sapiens
  Payload ID: 13053
  Gene Symbol: KCNMA1
  Gene Name: potassium channel, calcium activated large conductance subfamily M alpha, member 1
  Uniprot ID: Q12791
  ENSP ID: ENSP00000286628
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65587 - protein, 1071 aa, Homo sapiens
  Payload ID: 13053
  Gene Symbol: KCNMA1
  Gene Name: potassium channel, calcium activated large conductance subfamily M alpha, member 1
  ENSP ID: ENSP00000346321
MISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRWEEHCSLWRLESKGNVRRLNYCRGQQTFSVKVKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65588 - protein, 1182 aa, Homo sapiens
  Payload ID: 13053
  Gene Symbol: KCNMA1
  Gene Name: potassium channel, calcium activated large conductance subfamily M alpha, member 1
  ENSP ID: ENSP00000361480
  MOD_RES (1)..(1): Any amino acid
XSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 65589 - protein, 1167 aa, Homo sapiens
  Payload ID: 13053
  Gene Symbol: KCNMA1
  Gene Name: potassium channel, calcium activated large conductance subfamily M alpha, member 1
  ENSP ID: ENSP00000361485
PKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 65590 - protein, 1152 aa, Homo sapiens
  Payload ID: 13053
  Gene Symbol: KCNMA1
  Gene Name: potassium channel, calcium activated large conductance subfamily M alpha, member 1
  ENSP ID: ENSP00000361498
  MOD_RES (1)..(1): Any amino acid
XNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 65591 - protein, 1171 aa, Homo sapiens
  Payload ID: 13053
  Gene Symbol: KCNMA1
  Gene Name: potassium channel, calcium activated large conductance subfamily M alpha, member 1
  ENSP ID: ENSP00000361514
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 65592 - protein, 1177 aa, Homo sapiens
  Payload ID: 13053
  Gene Symbol: KCNMA1
  Gene Name: potassium channel, calcium activated large conductance subfamily M alpha, member 1
  ENSP ID: ENSP00000361517
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 65593 - protein, 1205 aa, Homo sapiens
  Payload ID: 13053
  Gene Symbol: KCNMA1
  Gene Name: potassium channel, calcium activated large conductance subfamily M alpha, member 1
  ENSP ID: ENSP00000361520
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 65594 - protein, 1040 aa, Homo sapiens
  Payload ID: 13053
  Gene Symbol: KCNMA1
  Gene Name: potassium channel, calcium activated large conductance subfamily M alpha, member 1
  ENSP ID: ENSP00000385552
MISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65595 - protein, 1288 aa, Homo sapiens
  Payload ID: 13053
  Gene Symbol: KCNMA1
  Gene Name: potassium channel, calcium activated large conductance subfamily M alpha, member 1
  ENSP ID: ENSP00000385717
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 65596 - protein, 1014 aa, Homo sapiens
  Payload ID: 13053
  Gene Symbol: KCNMA1
  Gene Name: potassium channel, calcium activated large conductance subfamily M alpha, member 1
  ENSP ID: ENSP00000385806
MISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 65597 - protein, 264 aa, Homo sapiens
  Payload ID: 13053
  Gene Symbol: KCNMA1
  Gene Name: potassium channel, calcium activated large conductance subfamily M alpha, member 1
  ENSP ID: ENSP00000388370
  MOD_RES (1)..(1): Any amino acid
XVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLAGSQDTHPDSFYHQAVNASSYLHGGGQMWPVSSSSSILLHYLRRQMPGPARLPLELSCQGSALSPNPDLYCMK

SEQ ID NO: 65598 - protein, 1209 aa, Homo sapiens
  Payload ID: 13053
  Gene Symbol: KCNMA1
  Gene Name: potassium channel, calcium activated large conductance subfamily M alpha, member 1
  ENSP ID: ENSP00000396608
SNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 65599 - protein, 886 aa, Homo sapiens
  Payload ID: 13053
  Gene Symbol: KCNMA1
  Gene Name: potassium channel, calcium activated large conductance subfamily M alpha, member 1
  ENSP ID: ENSP00000402150
  MOD_RES (1)..(1): Any amino acid
XNSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65600 - protein, 180 aa, Homo sapiens
  Payload ID: 13053
  Gene Symbol: KCNMA1
  Gene Name: potassium channel, calcium activated large conductance subfamily M alpha, member 1
  ENSP ID: ENSP00000402254
  MOD_RES (1)..(1): Any amino acid
XKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRPPQLCLPLAAQKRCFQSDKLDIFI

SEQ ID NO: 65601 - protein, 1042 aa, Homo sapiens
  Payload ID: 13053
  Gene Symbol: KCNMA1
  Gene Name: potassium channel, calcium activated large conductance subfamily M alpha, member 1
  ENSP ID: ENSP00000473714
GTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 65602 - protein, 168 aa, Homo sapiens
  Payload ID: 13053
  Gene Symbol: KCNMA1
  Gene Name: potassium channel, calcium activated large conductance subfamily M alpha, member 1
  Uniprot ID: Q12791
  ENSP ID: ENSP00000474686
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKATHFGSPEMPPAARSWSGSPPEAAVLRGASSLALEVARCRRL

SEQ ID NO: 65603 - protein, 128 aa, Homo sapiens
  Payload ID: 13053
  Gene Symbol: KCNMA1
  Gene Name: potassium channel, calcium activated large conductance subfamily M alpha, member 1
  ENSP ID: ENSP00000475086
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKVL

SEQ ID NO: 65604 - protein, 213 aa, Homo sapiens
  Payload ID: 13053
  Gene Symbol: KCNMA1
  Gene Name: potassium channel, calcium activated large conductance subfamily M alpha, member 1
  ENSP ID: ENSP00000482747
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKGCWRLRLGPGSGTHRLGCRGAGWGQPTQRGRRKLGAAGCVFCTAHLPGLGSWRWARGSTSAHTLGTCWGDEFVGSERREKSFGQGRE

SEQ ID NO: 65605 - protein, 1219 aa, Homo sapiens
  Payload ID: 13053
  Gene Symbol: KCNMA1
  Gene Name: potassium channel, calcium activated large conductance subfamily M alpha, member 1
  Uniprot ID: Q12791
  ENSP ID: ENSP00000485867
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILVTGWMPYLGPRVLMTCLDIGVVCMPTDIQSTSPASIKKFKETRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 65606 - protein, 139 aa, Homo sapiens
  Payload ID: 13054
  Gene Symbol: KCNJ1
  Gene Name: potassium channel, inwardly rectifying subfamily J, member 1
  ENSP ID: ENSP00000316136
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIF

SEQ ID NO: 65607 - protein, 372 aa, Homo sapiens
  Payload ID: 13054
  Gene Symbol: KCNJ1
  Gene Name: potassium channel, inwardly rectifying subfamily J, member 1
  Uniprot ID: P48048
  ENSP ID: ENSP00000316233
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 65608 - protein, 391 aa, Homo sapiens
  Payload ID: 13054
  Gene Symbol: KCNJ1
  Gene Name: potassium channel, inwardly rectifying subfamily J, member 1
  Uniprot ID: P48048
  ENSP ID: ENSP00000376432
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 65609 - protein, 372 aa, Homo sapiens; identical to SEQ ID NO: 65607
  Payload ID: 13054
  Gene Symbol: KCNJ1
  Gene Name: potassium channel, inwardly rectifying subfamily J, member 1
  Uniprot ID: P48048
  ENSP ID: ENSP00000376433

SEQ ID NO: 65610 - protein, 372 aa, Homo sapiens; identical to SEQ ID NO: 65607
  Payload ID: 13054
  Gene Symbol: KCNJ1
  Gene Name: potassium channel, inwardly rectifying subfamily J, member 1
  Uniprot ID: P48048
  ENSP ID: ENSP00000376434

SEQ ID NO: 65611 - protein, 372 aa, Homo sapiens; identical to SEQ ID NO: 65607
  Payload ID: 13054
  Gene Symbol: KCNJ1
  Gene Name: potassium channel, inwardly rectifying subfamily J, member 1
  Uniprot ID: P48048
  ENSP ID: ENSP00000406320

SEQ ID NO: 65612 - protein, 379 aa, Homo sapiens
  Payload ID: 13055
  Gene Symbol: KCNJ10
  Gene Name: potassium channel, inwardly rectifying subfamily J, member 10
  Uniprot ID: P78508
  ENSP ID: ENSP00000357068
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 65613 - protein, 390 aa, Homo sapiens
  Payload ID: 13056
  Gene Symbol: KCNJ11
  Gene Name: potassium channel, inwardly rectifying subfamily J, member 11
  Uniprot ID: Q14654
  ENSP ID: ENSP00000345708
MLSRKGIIPEEYVLTRLAEDPAKPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 65614 - protein, 153 aa, Homo sapiens
  Payload ID: 13056
  Gene Symbol: KCNJ11
  Gene Name: potassium channel, inwardly rectifying subfamily J, member 11
  ENSP ID: ENSP00000432729
MAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPM

SEQ ID NO: 65615 - protein, 303 aa, Homo sapiens
  Payload ID: 13056
  Gene Symbol: KCNJ11
  Gene Name: potassium channel, inwardly rectifying subfamily J, member 11
  Uniprot ID: Q14654
  ENSP ID: ENSP00000434755
MAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 65616 - protein, 155 aa, Homo sapiens
  Payload ID: 13056
  Gene Symbol: KCNJ11
  Gene Name: potassium channel, inwardly rectifying subfamily J, member 11
  ENSP ID: ENSP00000436479
  MOD_RES (1)..(1): Any amino acid
XLEPGSPKARQGIIPEEYVLTRLAEDPAKPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILIL

SEQ ID NO: 65617 - protein, 433 aa, Homo sapiens
  Payload ID: 13057
  Gene Symbol: KCNJ12
  Gene Name: potassium channel, inwardly rectifying subfamily J, member 12
  Uniprot ID: Q14500
  ENSP ID: ENSP00000328150
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 65618 - protein, 433 aa, Homo sapiens; identical to SEQ ID NO: 65617
  Payload ID: 13057
  Gene Symbol: KCNJ12
  Gene Name: potassium channel, inwardly rectifying subfamily J, member 12
  Uniprot ID: Q14500
  ENSP ID: ENSP00000463778

SEQ ID NO: 65619 - protein, 360 aa, Homo sapiens
  Payload ID: 13058
  Gene Symbol: KCNJ13
  Gene Name: potassium channel, inwardly rectifying subfamily J, member 13
  Uniprot ID: O60928
  ENSP ID: ENSP00000233826
MDSSNCKVIAPLLSQRYRRMVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 65620 - protein, 360 aa, Homo sapiens; identical to SEQ ID NO: 65619
  Payload ID: 13058
  Gene Symbol: KCNJ13
  Gene Name: potassium channel, inwardly rectifying subfamily J, member 13
  Uniprot ID: O60928
  ENSP ID: ENSP00000386251

SEQ ID NO: 65621 - protein, 94 aa, Homo sapiens
  Payload ID: 13058
  Gene Symbol: KCNJ13
  Gene Name: potassium channel, inwardly rectifying subfamily J, member 13
  Uniprot ID: O60928
  ENSP ID: ENSP00000386408
MDSSNCKVIAPLLSQRYRRMVTKDGHSTLQMDGAQRGLAYLRDAWGILMDMRWRWMMLVFSASFVVHWLVFAVLWCFCGEDCPAKKSSFFNSLY

SEQ ID NO: 65622 - protein, 184 aa, Homo sapiens
  Payload ID: 13058
  Gene Symbol: KCNJ13
  Gene Name: potassium channel, inwardly rectifying subfamily J, member 13
  ENSP ID: ENSP00000407284
MNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSH

SEQ ID NO: 65623 - protein, 137 aa, Homo sapiens
  Payload ID: 13058
  Gene Symbol: KCNJ13
  Gene Name: potassium channel, inwardly rectifying subfamily J, member 13
  ENSP ID: ENSP00000416896
  MOD_RES (1)..(1): Any amino acid
XAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGGHWRNMPKEDILPTV

SEQ ID NO: 65624 - protein, 436 aa, Homo sapiens
  Payload ID: 13059
  Gene Symbol: KCNJ14
  Gene Name: potassium channel, inwardly rectifying subfamily J, member 14
  Uniprot ID: Q9UNX9
  ENSP ID: ENSP00000341479
MGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 65625 - protein, 436 aa, Homo sapiens; identical to SEQ ID NO: 65624
  Payload ID: 13059
  Gene Symbol: KCNJ14
  Gene Name: potassium channel, inwardly rectifying subfamily J, member 14
  Uniprot ID: Q9UNX9
  ENSP ID: ENSP00000375756

SEQ ID NO: 65626 - protein, 375 aa, Homo sapiens
  Payload ID: 13060
  Gene Symbol: KCNJ15
  Gene Name: potassium channel, inwardly rectifying subfamily J, member 15
  Uniprot ID: Q99712
  ENSP ID: ENSP00000331698
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 65627 - protein, 61 aa, Homo sapiens
  Payload ID: 13060
  Gene Symbol: KCNJ15
  Gene Name: potassium channel, inwardly rectifying subfamily J, member 15
  ENSP ID: ENSP00000381899
MDAIHIGMSSTPLVKHTAGAGLKANRPRVMSKSGHSNVRIDKVDGIYLLYLQDLWTTVIDM

SEQ ID NO: 65628 - protein, 156 aa, Homo sapiens
  Payload ID: 13060
  Gene Symbol: KCNJ15
  Gene Name: potassium channel, inwardly rectifying subfamily J, member 15
  ENSP ID: ENSP00000381901
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLI

SEQ ID NO: 65629 - protein, 156 aa, Homo sapiens; identical to SEQ ID NO: 65628
  Payload ID: 13060
  Gene Symbol: KCNJ15
  Gene Name: potassium channel, inwardly rectifying subfamily J, member 15
  ENSP ID: ENSP00000381902

SEQ ID NO: 65630 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000381904

SEQ ID NO: 65631 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000381905

SEQ ID NO: 65632 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000381907

SEQ ID NO: 65633 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000381911

SEQ ID NO: 65634 - protein, 19 aa, Homo sapiens
  Payload ID: 13060
  Gene Symbol: KCNJ15
  Gene Name: potassium channel, inwardly rectifying subfamily J, member 15
  ENSP ID: ENSP00000392951
MDAIHIGMSSTPLVKHTAG

SEQ ID NO: 65635 - protein, 139 aa, Homo sapiens
  Payload ID: 13060
  Gene Symbol: KCNJ15
  Gene Name: potassium channel, inwardly rectifying subfamily J, member 15
  ENSP ID: ENSP00000400849
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEEC

SEQ ID NO: 65636 - protein, 39 aa, Homo sapiens
  Payload ID: 13060
  Gene Symbol: KCNJ15
  Gene Name: potassium channel, inwardly rectifying subfamily J, member 15
  ENSP ID: ENSP00000413013
MDAIHIGMSSTPLVKHTAGAGLKANRPRVMSKSGHSNVR

SEQ ID NO: 65637 - protein, 245 aa, Homo sapiens
  Payload ID: 13060
  Gene Symbol: KCNJ15
  Gene Name: potassium channel, inwardly rectifying subfamily J, member 15
  ENSP ID: ENSP00000414487
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSES

SEQ ID NO: 65638 - protein, 48 aa, Homo sapiens
  Payload ID: 13060
  Gene Symbol: KCNJ15
  Gene Name: potassium channel, inwardly rectifying subfamily J, member 15
  ENSP ID: ENSP00000447111
MDAIHIGMSSTPLVKHTAGAGLKANRPRVMSKSGHSNVRIDKVDGIYL

SEQ ID NO: 65639 - protein, 48 aa, Homo sapiens; identical to SEQ ID NO: 65638
  Payload ID: 13060
  Gene Symbol: KCNJ15
  Gene Name: potassium channel, inwardly rectifying subfamily J, member 15
  ENSP ID: ENSP00000448676

SEQ ID NO: 65640 - protein, 48 aa, Homo sapiens; identical to SEQ ID NO: 65638
  Payload ID: 13060
  Gene Symbol: KCNJ15
  Gene Name: potassium channel, inwardly rectifying subfamily J, member 15
  ENSP ID: ENSP00000448770

SEQ ID NO: 65641 - protein, 48 aa, Homo sapiens; identical to SEQ ID NO: 65638
  Payload ID: 13060
  Gene Symbol: KCNJ15
  Gene Name: potassium channel, inwardly rectifying subfamily J, member 15
  ENSP ID: ENSP00000448886

SEQ ID NO: 65642 - protein, 25 aa, Homo sapiens
  Payload ID: 13060
  Gene Symbol: KCNJ15
  Gene Name: potassium channel, inwardly rectifying subfamily J, member 15
  ENSP ID: ENSP00000449140
MDAIHIGMSSTPLVKHTAGAGLKAN

SEQ ID NO: 65643 - protein, 48 aa, Homo sapiens; identical to SEQ ID NO: 65638
  Payload ID: 13060
  Gene Symbol: KCNJ15
  Gene Name: potassium channel, inwardly rectifying subfamily J, member 15
  ENSP ID: ENSP00000449419

SEQ ID NO: 65644 - protein, 48 aa, Homo sapiens; identical to SEQ ID NO: 65638
  Payload ID: 13060
  Gene Symbol: KCNJ15
  Gene Name: potassium channel, inwardly rectifying subfamily J, member 15
  ENSP ID: ENSP00000450254

SEQ ID NO: 65645 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000479100

SEQ ID NO: 65646 - protein, 375 aa, Homo sapiens; identical to SEQ ID NO: 65626
  Payload ID: 13060
  Gene Symbol: KCNJ15
  Gene Name: potassium channel, inwardly rectifying subfamily J, member 15
  Uniprot ID: Q99712
  ENSP ID: ENSP00000484960

SEQ ID NO: 65647 - protein, 418 aa, Homo sapiens
  Payload ID: 13061
  Gene Symbol: KCNJ16
  Gene Name: potassium channel, inwardly rectifying subfamily J, member 16
  Uniprot ID: Q9NPI9
  ENSP ID: ENSP00000283936
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 65648 - protein, 418 aa, Homo sapiens; identical to SEQ ID NO: 65647
  Payload ID: 13061
  Gene Symbol: KCNJ16
  Gene Name: potassium channel, inwardly rectifying subfamily J, member 16
  Uniprot ID: Q9NPI9
  ENSP ID: ENSP00000376438

SEQ ID NO: 65649 - protein, 418 aa, Homo sapiens; identical to SEQ ID NO: 65647
  Payload ID: 13061
  Gene Symbol: KCNJ16
  Gene Name: potassium channel, inwardly rectifying subfamily J, member 16
  Uniprot ID: Q9NPI9
  ENSP ID: ENSP00000376439

SEQ ID NO: 65650 - protein, 35 aa, Homo sapiens
  Payload ID: 13061
  Gene Symbol: KCNJ16
  Gene Name: potassium channel, inwardly rectifying subfamily J, member 16
  ENSP ID: ENSP00000465163
MSYYGSSYHIINADAKYPGYPPEHIIAEKRRARRR

SEQ ID NO: 65651 - protein, 453 aa, Homo sapiens
  Payload ID: 13061
  Gene Symbol: KCNJ16
  Gene Name: potassium channel, inwardly rectifying subfamily J, member 16
  ENSP ID: ENSP00000465295
MLKMVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 65652 - protein, 35 aa, Homo sapiens; identical to SEQ ID NO: 65650
  Payload ID: 13061
  Gene Symbol: KCNJ16
  Gene Name: potassium channel, inwardly rectifying subfamily J, member 16
  ENSP ID: ENSP00000465646

SEQ ID NO: 65653 - protein, 418 aa, Homo sapiens; identical to SEQ ID NO: 65647
  Payload ID: 13061
  Gene Symbol: KCNJ16
  Gene Name: potassium channel, inwardly rectifying subfamily J, member 16
  Uniprot ID: Q9NPI9
  ENSP ID: ENSP00000465967

SEQ ID NO: 65654 - protein, 64 aa, Homo sapiens
  Payload ID: 13061
  Gene Symbol: KCNJ16
  Gene Name: potassium channel, inwardly rectifying subfamily J, member 16
  ENSP ID: ENSP00000466132
MSYYGSSYHIINADAKYPGYPPEHIIAEKRRARRRLLHKDGSCNVYFKHIFGEWGSYVVDIFTT

SEQ ID NO: 65655 - protein, 457 aa, Homo sapiens
  Payload ID: 13061
  Gene Symbol: KCNJ16
  Gene Name: potassium channel, inwardly rectifying subfamily J, member 16
  ENSP ID: ENSP00000467568
MILQKCRKVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 65656 - protein, 418 aa, Homo sapiens; identical to SEQ ID NO: 65647
  Payload ID: 13061
  Gene Symbol: KCNJ16
  Gene Name: potassium channel, inwardly rectifying subfamily J, member 16
  Uniprot ID: Q9NPI9
  ENSP ID: ENSP00000479817

SEQ ID NO: 65657 - protein, 433 aa, Homo sapiens
  Payload ID: 13062
  Gene Symbol: KCNJ18
  Gene Name: potassium channel, inwardly rectifying subfamily J, member 18
  Uniprot ID: B7U540
  ENSP ID: ENSP00000457807
MTAASRANPYSIVSLEEDGLHLVTMSGANGFGNGKVHTRRRCRNRFVKKNGQCNIAFANMDEKSQRYLADMFTTCVDIRWRYMLLIFSLAFLASWLLFGVIFWVIAVAHGDLEPAEGHGRTPCVMQVHGFMAAFLFSIETQTTIGYGLRCVTEECLVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRGSEI

SEQ ID NO: 65658 - protein, 427 aa, Homo sapiens
  Payload ID: 13063
  Gene Symbol: KCNJ2
  Gene Name: potassium channel, inwardly rectifying subfamily J, member 2
  Uniprot ID: P63252
  ENSP ID: ENSP00000243457
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 65659 - protein, 427 aa, Homo sapiens; identical to SEQ ID NO: 65658
  Payload ID: 13063
  Gene Symbol: KCNJ2
  Gene Name: potassium channel, inwardly rectifying subfamily J, member 2
  Uniprot ID: P63252
  ENSP ID: ENSP00000441848

SEQ ID NO: 65660 - protein, 501 aa, Homo sapiens
  Payload ID: 13064
  Gene Symbol: KCNJ3
  Gene Name: potassium channel, inwardly rectifying subfamily J, member 3
  Uniprot ID: P48549
  ENSP ID: ENSP00000295101
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 65661 - protein, 235 aa, Homo sapiens
  Payload ID: 13064
  Gene Symbol: KCNJ3
  Gene Name: potassium channel, inwardly rectifying subfamily J, member 3
  Uniprot ID: P48549
  ENSP ID: ENSP00000438410
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKG

SEQ ID NO: 65662 - protein, 445 aa, Homo sapiens
  Payload ID: 13065
  Gene Symbol: KCNJ4
  Gene Name: potassium channel, inwardly rectifying subfamily J, member 4
  Uniprot ID: P48050
  ENSP ID: ENSP00000306497
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 65663 - protein, 419 aa, Homo sapiens
  Payload ID: 13066
  Gene Symbol: KCNJ5
  Gene Name: potassium channel, inwardly rectifying subfamily J, member 5
  Uniprot ID: P48544
  ENSP ID: ENSP00000339960
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 65664 - protein, 419 aa, Homo sapiens; identical to SEQ ID NO: 65663
  Payload ID: 13066
  Gene Symbol: KCNJ5
  Gene Name: potassium channel, inwardly rectifying subfamily J, member 5
  Uniprot ID: P48544
  ENSP ID: ENSP00000433295

SEQ ID NO: 65665 - protein, 419 aa, Homo sapiens; identical to SEQ ID NO: 65663
  Payload ID: 13066
  Gene Symbol: KCNJ5
  Gene Name: potassium channel, inwardly rectifying subfamily J, member 5
  Uniprot ID: P48544
  ENSP ID: ENSP00000434266

SEQ ID NO: 65666 - protein, 423 aa, Homo sapiens
  Payload ID: 13067
  Gene Symbol: KCNJ6
  Gene Name: potassium channel, inwardly rectifying subfamily J, member 6
  Uniprot ID: P48051
  ENSP ID: ENSP00000477437
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 65667 - protein, 424 aa, Homo sapiens
  Payload ID: 13068
  Gene Symbol: KCNJ8
  Gene Name: potassium channel, inwardly rectifying subfamily J, member 8
  Uniprot ID: Q15842
  ENSP ID: ENSP00000240662
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 65668 - protein, 114 aa, Homo sapiens
  Payload ID: 13068
  Gene Symbol: KCNJ8
  Gene Name: potassium channel, inwardly rectifying subfamily J, member 8
  ENSP ID: ENSP00000440012
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSG

SEQ ID NO: 65669 - protein, 393 aa, Homo sapiens
  Payload ID: 13069
  Gene Symbol: KCNJ9
  Gene Name: potassium channel, inwardly rectifying subfamily J, member 9
  Uniprot ID: Q92806
  ENSP ID: ENSP00000357067
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 65670 - protein, 1223 aa, Homo sapiens
  Payload ID: 13070
  Gene Symbol: KCNT1
  Gene Name: potassium channel, sodium activated subfamily T, member 1
  ENSP ID: ENSP00000263604
MARAKLPRSPSEGKAGPGGAPAGAAAPEEPHGLSPLLPARGGGSVGSDVGQRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65671 - protein, 1235 aa, Homo sapiens
  Payload ID: 13070
  Gene Symbol: KCNT1
  Gene Name: potassium channel, sodium activated subfamily T, member 1
  Uniprot ID: Q5JUK3
  ENSP ID: ENSP00000360822
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYDEMNDHQNTLSYVLINPPPDTRLEPSDIVYLIRSDPLAHVASSSQSRKSSCSHKLSSCNPETRDETQL

SEQ ID NO: 65672 - protein, 1217 aa, Homo sapiens
  Payload ID: 13070
  Gene Symbol: KCNT1
  Gene Name: potassium channel, sodium activated subfamily T, member 1
  ENSP ID: ENSP00000417578
MSDLDSEVLPLPPRYRFRDLLLGDPSFQNDDRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65673 - protein, 1256 aa, Homo sapiens
  Payload ID: 13070
  Gene Symbol: KCNT1
  Gene Name: potassium channel, sodium activated subfamily T, member 1
  Uniprot ID: Q5JUK3
  ENSP ID: ENSP00000417851
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65674 - protein, 1235 aa, Homo sapiens
  Payload ID: 13070
  Gene Symbol: KCNT1
  Gene Name: potassium channel, sodium activated subfamily T, member 1
  ENSP ID: ENSP00000418003
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65675 - protein, 122 aa, Homo sapiens
  Payload ID: 13070
  Gene Symbol: KCNT1
  Gene Name: potassium channel, sodium activated subfamily T, member 1
  ENSP ID: ENSP00000418777
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSQKRAEPTRRV

SEQ ID NO: 65676 - protein, 1230 aa, Homo sapiens
  Payload ID: 13070
  Gene Symbol: KCNT1
  Gene Name: potassium channel, sodium activated subfamily T, member 1
  Uniprot ID: Q5JUK3
  ENSP ID: ENSP00000419007
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSESQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65677 - protein, 1216 aa, Homo sapiens
  Payload ID: 13070
  Gene Symbol: KCNT1
  Gene Name: potassium channel, sodium activated subfamily T, member 1
  ENSP ID: ENSP00000419086
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYDEMNDHQNTLSYVLINPPPDTRLEPSDIVYLIRSDPLAHVASSSQSRKSSCSHKLSSCNPETRDETQL

SEQ ID NO: 65678 - protein, 285 aa, Homo sapiens
  Payload ID: 13070
  Gene Symbol: KCNT1
  Gene Name: potassium channel, sodium activated subfamily T, member 1
  ENSP ID: ENSP00000420764
MSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVA

SEQ ID NO: 65679 - protein, 1237 aa, Homo sapiens
  Payload ID: 13070
  Gene Symbol: KCNT1
  Gene Name: potassium channel, sodium activated subfamily T, member 1
  ENSP ID: ENSP00000486130
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65680 - protein, 1211 aa, Homo sapiens
  Payload ID: 13070
  Gene Symbol: KCNT1
  Gene Name: potassium channel, sodium activated subfamily T, member 1
  Uniprot ID: Q5JUK3
  ENSP ID: ENSP00000486374
MPLPDGARTPGGVCREARGGGYTNRTFEFDDGQCAPRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGGCRTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65681 - protein, 1201 aa, Homo sapiens
  Payload ID: 13070
  Gene Symbol: KCNT1
  Gene Name: potassium channel, sodium activated subfamily T, member 1
  ENSP ID: ENSP00000486486
MSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 65682 - protein, 177 aa, Homo sapiens
  Payload ID: 13070
  Gene Symbol: KCNT1
  Gene Name: potassium channel, sodium activated subfamily T, member 1
  ENSP ID: ENSP00000486830
DSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKTAVPTGPTTTSWKPSAASPWSTTWRALWTTWTACCSVASSMRTTWWWWTRRAP

SEQ ID NO: 65683 - protein, 1135 aa, Homo sapiens
  Payload ID: 13071
  Gene Symbol: KCNT2
  Gene Name: potassium channel, sodium activated subfamily T, member 2
  Uniprot ID: Q6UVM3
  ENSP ID: ENSP00000294725
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 65684 - protein, 1111 aa, Homo sapiens
  Payload ID: 13071
  Gene Symbol: KCNT2
  Gene Name: potassium channel, sodium activated subfamily T, member 2
  Uniprot ID: Q6UVM3
  ENSP ID: ENSP00000356403
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 65685 - protein, 370 aa, Homo sapiens
  Payload ID: 13071
  Gene Symbol: KCNT2
  Gene Name: potassium channel, sodium activated subfamily T, member 2
  ENSP ID: ENSP00000405474
MPYLHLDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNP

SEQ ID NO: 65686 - protein, 1068 aa, Homo sapiens
  Payload ID: 13071
  Gene Symbol: KCNT2
  Gene Name: potassium channel, sodium activated subfamily T, member 2
  Uniprot ID: Q6UVM3
  ENSP ID: ENSP00000476657
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESRKIASQSQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 65687 - protein, 169 aa, Homo sapiens
  Payload ID: 13071
  Gene Symbol: KCNT2
  Gene Name: potassium channel, sodium activated subfamily T, member 2
  ENSP ID: ENSP00000477456
  MOD_RES (1)..(1): Any amino acid
XRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFAVLKAGNPRSRCQHDPVLRRPAIARTMAEDVR

SEQ ID NO: 65688 - protein, 1149 aa, Homo sapiens
  Payload ID: 13072
  Gene Symbol: KCNU1
  Gene Name: potassium channel, subfamily U, member 1
  Uniprot ID: A8MYU2
  ENSP ID: ENSP00000382770
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 65689 - protein, 51 aa, Homo sapiens
  Payload ID: 13072
  Gene Symbol: KCNU1
  Gene Name: potassium channel, subfamily U, member 1
  ENSP ID: ENSP00000428106
MIKKTEFSNVCSIFYLILQAMLKGLLQLSCPGIASDAGDRRSKFSAGTTFR

SEQ ID NO: 65690 - protein, 947 aa, Homo sapiens
  Payload ID: 13072
  Gene Symbol: KCNU1
  Gene Name: potassium channel, subfamily U, member 1
  ENSP ID: ENSP00000428552
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATLMWKLAIKGSQFQGRSSGLCWPSTIIMSWNCFRCW

SEQ ID NO: 65691 - protein, 113 aa, Homo sapiens
  Payload ID: 13072
  Gene Symbol: KCNU1
  Gene Name: potassium channel, subfamily U, member 1
  ENSP ID: ENSP00000429149
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLPCWKLFII

SEQ ID NO: 65692 - protein, 308 aa, Homo sapiens
  Payload ID: 13072
  Gene Symbol: KCNU1
  Gene Name: potassium channel, subfamily U, member 1
  ENSP ID: ENSP00000429951
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLVKNIFNI

SEQ ID NO: 65693 - protein, 336 aa, Homo sapiens
  Payload ID: 13073
  Gene Symbol: KCNK1
  Gene Name: potassium channel, two pore domain subfamily K, member 1
  Uniprot ID: O00180
  ENSP ID: ENSP00000355580
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 65694 - protein, 242 aa, Homo sapiens
  Payload ID: 13073
  Gene Symbol: KCNK1
  Gene Name: potassium channel, two pore domain subfamily K, member 1
  ENSP ID: ENSP00000409626
VLRVLSPDLVRRLLNLAVRAFQVPKGESLNFPESTPGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVAT

SEQ ID NO: 65695 - protein, 543 aa, Homo sapiens
  Payload ID: 13074
  Gene Symbol: KCNK10
  Gene Name: potassium channel, two pore domain subfamily K, member 10
  Uniprot ID: P57789
  ENSP ID: ENSP00000310568
MEDGFKGDRTEGCRSDSVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 65696 - protein, 543 aa, Homo sapiens
  Payload ID: 13074
  Gene Symbol: KCNK10
  Gene Name: potassium channel, two pore domain subfamily K, member 10
  Uniprot ID: P57789
  ENSP ID: ENSP00000312811
MKFPIETPRKQVNWDPKVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 65697 - protein, 538 aa, Homo sapiens
  Payload ID: 13074
  Gene Symbol: KCNK10
  Gene Name: potassium channel, two pore domain subfamily K, member 10
  Uniprot ID: P57789
  ENSP ID: ENSP00000343104
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 65698 - protein, 156 aa, Homo sapiens
  Payload ID: 13074
  Gene Symbol: KCNK10
  Gene Name: potassium channel, two pore domain subfamily K, member 10
  ENSP ID: ENSP00000452587
MAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTI

SEQ ID NO: 65699 - protein, 430 aa, Homo sapiens
  Payload ID: 13075
  Gene Symbol: KCNK12
  Gene Name: potassium channel, two pore domain subfamily K, member 12
  Uniprot ID: Q9HB15
  ENSP ID: ENSP00000327611
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 65700 - protein, 408 aa, Homo sapiens
  Payload ID: 13076
  Gene Symbol: KCNK13
  Gene Name: potassium channel, two pore domain subfamily K, member 13
  Uniprot ID: Q9HB14
  ENSP ID: ENSP00000282146
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 65701 - protein, 330 aa, Homo sapiens
  Payload ID: 13077
  Gene Symbol: KCNK15
  Gene Name: potassium channel, two pore domain subfamily K, member 15
  Uniprot ID: Q9H427
  ENSP ID: ENSP00000361952
MRRPSVRAAGLVLCTLCYLLVGAAVFDALESEAESGRQRLLVQKRGALRRKFGFSAEDYRELERLALQAEPHRAGRQWKFPGSFYFAITVITTIEYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARTPSPRPPGAPESRGLWLPRRPARSVGSASVFCHVHKLERCARDNLGFSPPSSPGVVRGGQAPRLGARWKSI

SEQ ID NO: 65702 - protein, 262 aa, Homo sapiens
  Payload ID: 13078
  Gene Symbol: KCNK16
  Gene Name: potassium channel, two pore domain subfamily K, member 16
  Uniprot ID: Q96T55
  ENSP ID: ENSP00000362324
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGLRQGCGAKAAPGRRPRRGSTAARGVQVTPQDFPISKKGLGS

SEQ ID NO: 65703 - protein, 309 aa, Homo sapiens
  Payload ID: 13078
  Gene Symbol: KCNK16
  Gene Name: potassium channel, two pore domain subfamily K, member 16
  Uniprot ID: Q96T55
  ENSP ID: ENSP00000362326
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 65704 - protein, 322 aa, Homo sapiens
  Payload ID: 13078
  Gene Symbol: KCNK16
  Gene Name: potassium channel, two pore domain subfamily K, member 16
  Uniprot ID: Q96T55
  ENSP ID: ENSP00000391498
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGHPLNFITPSGLLPSQEPFQTPHGKPESQQIPGSFQKVSSMNVWPLSGMHSPGLAFPLPDCNIPDQERFRPLHPGAWKFWPLPLPSSNSKWAPMWLGSSAQV

SEQ ID NO: 65705 - protein, 294 aa, Homo sapiens
  Payload ID: 13078
  Gene Symbol: KCNK16
  Gene Name: potassium channel, two pore domain subfamily K, member 16
  Uniprot ID: Q96T55
  ENSP ID: ENSP00000415375
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSRGLGVKDGAASDPSGLPRPQKIPISA

SEQ ID NO: 65706 - protein, 197 aa, Homo sapiens
  Payload ID: 13078
  Gene Symbol: KCNK16
  Gene Name: potassium channel, two pore domain subfamily K, member 16
  ENSP ID: ENSP00000423842
MEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGLRQGCGAKAAPGRRPRRGSTAARGVQVTPQDFPISKKGLGS

SEQ ID NO: 65707 - protein, 332 aa, Homo sapiens
  Payload ID: 13079
  Gene Symbol: KCNK17
  Gene Name: potassium channel, two pore domain subfamily K, member 17
  Uniprot ID: Q96T54
  ENSP ID: ENSP00000362328
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 65708 - protein, 271 aa, Homo sapiens
  Payload ID: 13079
  Gene Symbol: KCNK17
  Gene Name: potassium channel, two pore domain subfamily K, member 17
  Uniprot ID: Q96T54
  ENSP ID: ENSP00000401271
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIASCLISDTRKPNRDWQTLERTSKSSGGLLKYRFLAGHGGSHL

SEQ ID NO: 65709 - protein, 384 aa, Homo sapiens
  Payload ID: 13080
  Gene Symbol: KCNK18
  Gene Name: potassium channel, two pore domain subfamily K, member 18
  Uniprot ID: Q7Z418
  ENSP ID: ENSP00000334650
MEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFKLVQNRLIDIYKNVMLFFAKGKFYHLVKK

SEQ ID NO: 65710 - protein, 411 aa, Homo sapiens
  Payload ID: 13081
  Gene Symbol: KCNK2
  Gene Name: potassium channel, two pore domain subfamily K, member 2
  Uniprot ID: O95069
  ENSP ID: ENSP00000375764
MAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 65711 - protein, 422 aa, Homo sapiens
  Payload ID: 13081
  Gene Symbol: KCNK2
  Gene Name: potassium channel, two pore domain subfamily K, member 2
  Uniprot ID: O95069
  ENSP ID: ENSP00000375765
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 65712 - protein, 426 aa, Homo sapiens
  Payload ID: 13081
  Gene Symbol: KCNK2
  Gene Name: potassium channel, two pore domain subfamily K, member 2
  Uniprot ID: O95069
  ENSP ID: ENSP00000394033
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 65713 - protein, 124 aa, Homo sapiens
  Payload ID: 13081
  Gene Symbol: KCNK2
  Gene Name: potassium channel, two pore domain subfamily K, member 2
  ENSP ID: ENSP00000413460
MKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALL

SEQ ID NO: 65714 - protein, 152 aa, Homo sapiens
  Payload ID: 13081
  Gene Symbol: KCNK2
  Gene Name: potassium channel, two pore domain subfamily K, member 2
  ENSP ID: ENSP00000418706
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQDLETSHHAQKAAKYSVSSMPYWEFPSLVFSWLELEIS

SEQ ID NO: 65715 - protein, 156 aa, Homo sapiens
  Payload ID: 13081
  Gene Symbol: KCNK2
  Gene Name: potassium channel, two pore domain subfamily K, member 2
  ENSP ID: ENSP00000419633
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQDLETSHHAQKAAKYSVSSMPYWEFPSLVFSWLELEIS

SEQ ID NO: 65716 - protein, 228 aa, Homo sapiens
  Payload ID: 13081
  Gene Symbol: KCNK2
  Gene Name: potassium channel, two pore domain subfamily K, member 2
  Uniprot ID: O95069
  ENSP ID: ENSP00000420203
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIVDPILNIWTSISLSCGSGSL

SEQ ID NO: 65717 - protein, 217 aa, Homo sapiens
  Payload ID: 13081
  Gene Symbol: KCNK2
  Gene Name: potassium channel, two pore domain subfamily K, member 2
  ENSP ID: ENSP00000420499
MAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIVDPILNIWTSISLSCGSGSL

SEQ ID NO: 65718 - protein, 118 aa, Homo sapiens
  Payload ID: 13081
  Gene Symbol: KCNK2
  Gene Name: potassium channel, two pore domain subfamily K, member 2
  ENSP ID: ENSP00000420569
MKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFC

SEQ ID NO: 65719 - protein, 394 aa, Homo sapiens
  Payload ID: 13082
  Gene Symbol: KCNK3
  Gene Name: potassium channel, two pore domain subfamily K, member 3
  Uniprot ID: O14649
  ENSP ID: ENSP00000306275
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 65720 - protein, 271 aa, Homo sapiens
  Payload ID: 13082
  Gene Symbol: KCNK3
  Gene Name: potassium channel, two pore domain subfamily K, member 3
  ENSP ID: ENSP00000483136
MFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 65721 - protein, 393 aa, Homo sapiens
  Payload ID: 13083
  Gene Symbol: KCNK4
  Gene Name: potassium channel, two pore domain subfamily K, member 4
  Uniprot ID: Q9NYG8
  ENSP ID: ENSP00000378033
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 65722 - protein, 393 aa, Homo sapiens; identical to SEQ ID NO: 65721
  Payload ID: 13083
  Gene Symbol: KCNK4
  Gene Name: potassium channel, two pore domain subfamily K, member 4
  Uniprot ID: Q9NYG8
  ENSP ID: ENSP00000402797

SEQ ID NO: 65723 - protein, 158 aa, Homo sapiens
  Payload ID: 13083
  Gene Symbol: KCNK4
  Gene Name: potassium channel, two pore domain subfamily K, member 4
  ENSP ID: ENSP00000441460
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFL

SEQ ID NO: 65724 - protein, 393 aa, Homo sapiens; identical to SEQ ID NO: 65721
  Payload ID: 13083
  Gene Symbol: KCNK4
  Gene Name: potassium channel, two pore domain subfamily K, member 4
  Uniprot ID: Q9NYG8
  ENSP ID: ENSP00000444948

SEQ ID NO: 65725 - protein, 310 aa, Homo sapiens
  Payload ID: 13083
  Gene Symbol: KCNK4
  Gene Name: potassium channel, two pore domain subfamily K, member 4
  ENSP ID: ENSP00000446454
MPWEGVRTQKPTRPATAATQPGTWAAPSFSQGPSSPPSAMAMWPCAQMPGASSASFMRWWGFRCLGSYWQGSGTGWAPPCAMASVTLKPSSCDAYHRGLWRLCGRRGPQAGLPGLSAAGVVLDPARPGLLRLSAHHHRELAASSVPPHSGRDGRPHGSGCQLDWHGDSARDPASRARRPAAGEGAATAASTALSSAAAGQAPIPFAPREGSAAFPAHGLGPGLSQREPGLHRRVLGYAERARLPAAPRAERSPPPKSPQEARAAPRPRASPRQRRAGVGAGSLAGPLKGFVSALPGMPGLFDQRALFPRD

SEQ ID NO: 65726 - protein, 499 aa, Homo sapiens
  Payload ID: 13084
  Gene Symbol: KCNK5
  Gene Name: potassium channel, two pore domain subfamily K, member 5
  Uniprot ID: O95279
  ENSP ID: ENSP00000352527
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 65727 - protein, 313 aa, Homo sapiens
  Payload ID: 13085
  Gene Symbol: KCNK6
  Gene Name: potassium channel, two pore domain subfamily K, member 6
  Uniprot ID: Q9Y257
  ENSP ID: ENSP00000263372
MRRGALLAGALAAYAAYLVLGALLVARLEGPHEARLRAELETLRAQLLQRSPCVAAPALDAFVERVLAAGRLGRVVLANASGSANASDPAWDFASALFFASTLITTVGYGYTTPLTDAGKAFSIAFALLGVPTTMLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 65728 - protein, 252 aa, Homo sapiens
  Payload ID: 13086
  Gene Symbol: KCNK7
  Gene Name: potassium channel, two pore domain subfamily K, member 7
  Uniprot ID: Q9Y2U2
  ENSP ID: ENSP00000343923
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGGGTSLQGTAWEG

SEQ ID NO: 65729 - protein, 307 aa, Homo sapiens
  Payload ID: 13086
  Gene Symbol: KCNK7
  Gene Name: potassium channel, two pore domain subfamily K, member 7
  Uniprot ID: Q9Y2U2
  ENSP ID: ENSP00000344820
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGYLLLGLLAMLLAVETFSELPQVRAMGKFFRPSGPVTAEDQGGILGQDELALSTLPPAAPASGQAPAC

SEQ ID NO: 65730 - protein, 257 aa, Homo sapiens
  Payload ID: 13086
  Gene Symbol: KCNK7
  Gene Name: potassium channel, two pore domain subfamily K, member 7
  Uniprot ID: Q9Y2U2
  ENSP ID: ENSP00000377764
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGKSSHLTACGGRGKRSLD

SEQ ID NO: 65731 - protein, 252 aa, Homo sapiens; identical to SEQ ID NO: 65728
  Payload ID: 13086
  Gene Symbol: KCNK7
  Gene Name: potassium channel, two pore domain subfamily K, member 7
  Uniprot ID: Q9Y2U2
  ENSP ID: ENSP00000377765

SEQ ID NO: 65732 - protein, 72 aa, Homo sapiens
  Payload ID: 13086
  Gene Symbol: KCNK7
  Gene Name: potassium channel, two pore domain subfamily K, member 7
  ENSP ID: ENSP00000431950
  MOD_RES (1)..(1): Any amino acid
XHLGQLALLGLLAMLLAVETFSELPQVRAMGKFFRPSGPVTAEDQGGILGQDELALSTLPPAAPASGQAPAC

SEQ ID NO: 65733 - protein, 28 aa, Homo sapiens
  Payload ID: 13086
  Gene Symbol: KCNK7
  Gene Name: potassium channel, two pore domain subfamily K, member 7
  ENSP ID: ENSP00000435449
  MOD_RES (1)..(1): Any amino acid
XLHPVIYHLGQLALLGGGTSLQGTAWEG

SEQ ID NO: 65734 - protein, 374 aa, Homo sapiens
  Payload ID: 13087
  Gene Symbol: KCNK9
  Gene Name: potassium channel, two pore domain subfamily K, member 9
  Uniprot ID: Q9NPC2
  ENSP ID: ENSP00000302166
MKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 65735 - protein, 374 aa, Homo sapiens; identical to SEQ ID NO: 65734
  Payload ID: 13087
  Gene Symbol: KCNK9
  Gene Name: potassium channel, two pore domain subfamily K, member 9
  Uniprot ID: Q9NPC2
  ENSP ID: ENSP00000429847

SEQ ID NO: 65736 - protein, 374 aa, Homo sapiens; identical to SEQ ID NO: 65734
  Payload ID: 13087
  Gene Symbol: KCNK9
  Gene Name: potassium channel, two pore domain subfamily K, member 9
  Uniprot ID: Q9NPC2
  ENSP ID: ENSP00000430676

SEQ ID NO: 65737 - protein, 989 aa, Homo sapiens
  Payload ID: 13088
  Gene Symbol: KCNH1
  Gene Name: potassium channel, voltage gated eag related subfamily H, member 1
  Uniprot ID: O95259
  ENSP ID: ENSP00000271751
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 65738 - protein, 962 aa, Homo sapiens
  Payload ID: 13088
  Gene Symbol: KCNH1
  Gene Name: potassium channel, voltage gated eag related subfamily H, member 1
  Uniprot ID: O95259
  ENSP ID: ENSP00000355974
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 65739 - protein, 1159 aa, Homo sapiens
  Payload ID: 13089
  Gene Symbol: KCNH2
  Gene Name: potassium channel, voltage gated eag related subfamily H, member 2
  Uniprot ID: Q12809
  ENSP ID: ENSP00000262186
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 65740 - protein, 819 aa, Homo sapiens
  Payload ID: 13089
  Gene Symbol: KCNH2
  Gene Name: potassium channel, voltage gated eag related subfamily H, member 2
  Uniprot ID: Q12809
  ENSP ID: ENSP00000328531
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 65741 - protein, 772 aa, Homo sapiens
  Payload ID: 13089
  Gene Symbol: KCNH2
  Gene Name: potassium channel, voltage gated eag related subfamily H, member 2
  ENSP ID: ENSP00000387657
MQRPCTCDFLHGPRTQRRAAAQIAQALLGAEERKVEIAFYRKDGSCFLCLVDVVPVKNEDGAVIMFILNFEVVMEKDMVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGMGWGAGTGLEMPSAASRGASLLNMQSLGLWTWDCLQGHWAPLIHLNSGPPSGAMERSPTWGEAAELWGSHILLPFRIRHKQTLFASLK

SEQ ID NO: 65742 - protein, 1083 aa, Homo sapiens
  Payload ID: 13090
  Gene Symbol: KCNH3
  Gene Name: potassium channel, voltage gated eag related subfamily H, member 3
  Uniprot ID: Q9ULD8
  ENSP ID: ENSP00000257981
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 65743 - protein, 1017 aa, Homo sapiens
  Payload ID: 13091
  Gene Symbol: KCNH4
  Gene Name: potassium channel, voltage gated eag related subfamily H, member 4
  Uniprot ID: Q9UQ05
  ENSP ID: ENSP00000264661
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 65744 - protein, 1017 aa, Homo sapiens; identical to SEQ ID NO: 65743
  Payload ID: 13091
  Gene Symbol: KCNH4
  Gene Name: potassium channel, voltage gated eag related subfamily H, member 4
  Uniprot ID: Q9UQ05
  ENSP ID: ENSP00000475564

SEQ ID NO: 65745 - protein, 988 aa, Homo sapiens
  Payload ID: 13092
  Gene Symbol: KCNH5
  Gene Name: potassium channel, voltage gated eag related subfamily H, member 5
  Uniprot ID: Q8NCM2
  ENSP ID: ENSP00000321427
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 65746 - protein, 624 aa, Homo sapiens
  Payload ID: 13092
  Gene Symbol: KCNH5
  Gene Name: potassium channel, voltage gated eag related subfamily H, member 5
  Uniprot ID: Q8NCM2
  ENSP ID: ENSP00000378419
MQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRGWFSMANAL

SEQ ID NO: 65747 - protein, 611 aa, Homo sapiens
  Payload ID: 13092
  Gene Symbol: KCNH5
  Gene Name: potassium channel, voltage gated eag related subfamily H, member 5
  Uniprot ID: Q8NCM2
  ENSP ID: ENSP00000395439
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILDHLS

SEQ ID NO: 65748 - protein, 958 aa, Homo sapiens
  Payload ID: 13093
  Gene Symbol: KCNH6
  Gene Name: potassium channel, voltage gated eag related subfamily H, member 6
  ENSP ID: ENSP00000318212
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 65749 - protein, 905 aa, Homo sapiens
  Payload ID: 13093
  Gene Symbol: KCNH6
  Gene Name: potassium channel, voltage gated eag related subfamily H, member 6
  Uniprot ID: Q9H252
  ENSP ID: ENSP00000396900
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACICSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 65750 - protein, 65 aa, Homo sapiens
  Payload ID: 13093
  Gene Symbol: KCNH6
  Gene Name: potassium channel, voltage gated eag related subfamily H, member 6
  ENSP ID: ENSP00000462417
MPVRRGHVAPQNTYLDTIIRKFEGQSRKFLIANAQMENCAIIYCNDGFCELFGYSRVEPPASAAW

SEQ ID NO: 65751 - protein, 994 aa, Homo sapiens
  Payload ID: 13093
  Gene Symbol: KCNH6
  Gene Name: potassium channel, voltage gated eag related subfamily H, member 6
  Uniprot ID: Q9H252
  ENSP ID: ENSP00000463533
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 65752 - protein, 905 aa, Homo sapiens; identical to SEQ ID NO: 65749
  Payload ID: 13093
  Gene Symbol: KCNH6
  Gene Name: potassium channel, voltage gated eag related subfamily H, member 6
  Uniprot ID: Q9H252
  ENSP ID: ENSP00000463830

SEQ ID NO: 65753 - protein, 502 aa, Homo sapiens
  Payload ID: 13093
  Gene Symbol: KCNH6
  Gene Name: potassium channel, voltage gated eag related subfamily H, member 6
  Uniprot ID: Q9H252
  ENSP ID: ENSP00000464672
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGCE

SEQ ID NO: 65754 - protein, 1196 aa, Homo sapiens
  Payload ID: 13094
  Gene Symbol: KCNH7
  Gene Name: potassium channel, voltage gated eag related subfamily H, member 7
  Uniprot ID: Q9NS40
  ENSP ID: ENSP00000331727
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 65755 - protein, 732 aa, Homo sapiens
  Payload ID: 13094
  Gene Symbol: KCNH7
  Gene Name: potassium channel, voltage gated eag related subfamily H, member 7
  Uniprot ID: Q9NS40
  ENSP ID: ENSP00000333781
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 65756 - protein, 1096 aa, Homo sapiens [sequence omitted]

SEQ ID NO: 65757 - protein, 630 aa, Homo sapiens
  Payload ID: 13094
  Gene Symbol: KCNH7
  Gene Name: potassium channel, voltage gated eag related subfamily H, member 7
  ENSP ID: ENSP00000483158
GSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 65758 - protein, 1107 aa, Homo sapiens
  Payload ID: 13095
  Gene Symbol: KCNH8
  Gene Name: potassium channel, voltage gated eag related subfamily H, member 8
  Uniprot ID: Q96L42
  ENSP ID: ENSP00000328813
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 65759 - protein, 195 aa, Homo sapiens
  Payload ID: 13095
  Gene Symbol: KCNH8
  Gene Name: potassium channel, voltage gated eag related subfamily H, member 8
  ENSP ID: ENSP00000412141
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNVLQDP

SEQ ID NO: 65760 - protein, 676 aa, Homo sapiens [sequence omitted]

SEQ ID NO: 65761 - protein, 549 aa, Homo sapiens
  Payload ID: 13096
  Gene Symbol: KCNQ1
  Gene Name: potassium channel, voltage gated KQT-like subfamily Q, member 1
  Uniprot ID: P51787
  ENSP ID: ENSP00000334497
MDFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 65762 - protein, 74 aa, Homo sapiens
  Payload ID: 13096
  Gene Symbol: KCNQ1
  Gene Name: potassium channel, voltage gated KQT-like subfamily Q, member 1
  ENSP ID: ENSP00000370153
MGHAASSTHWVQLSAVCCPGGRSGEGLSIQEIKHTVTRVQSSVKRSSGYTPRGFSFDPGFLIVLVCLIFSVLST

SEQ ID NO: 65763 - protein, 193 aa, Homo sapiens
  Payload ID: 13096
  Gene Symbol: KCNQ1
  Gene Name: potassium channel, voltage gated KQT-like subfamily Q, member 1
  ENSP ID: ENSP00000434560
MTRAGLSSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFV

SEQ ID NO: 65764 - protein, 172 aa, Homo sapiens
  Payload ID: 13096
  Gene Symbol: KCNQ1
  Gene Name: potassium channel, voltage gated KQT-like subfamily Q, member 1
  ENSP ID: ENSP00000488381
  MOD_RES (1)..(1): Any amino acid
XLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 65765 - protein, 172 aa, Homo sapiens; identical to SEQ ID NO: 65764
  Payload ID: 13096
  Gene Symbol: KCNQ1
  Gene Name: potassium channel, voltage gated KQT-like subfamily Q, member 1
  ENSP ID: ENSP00000488783
  MOD_RES (1)..(1): Any amino acid

SEQ ID NO: 65766 - protein, 841 aa, Homo sapiens
  Payload ID: 13097
  Gene Symbol: KCNQ2
  Gene Name: potassium channel, voltage gated KQT-like subfamily Q, member 2
  Uniprot ID: O43526
  ENSP ID: ENSP00000339611
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 65767 - protein, 393 aa, Homo sapiens
  Payload ID: 13097
  Gene Symbol: KCNQ2
  Gene Name: potassium channel, voltage gated KQT-like subfamily Q, member 2
  Uniprot ID: O43526
  ENSP ID: ENSP00000345523
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRYRRRAPATKQLFHFLFSICS

SEQ ID NO: 65768 - protein, 728 aa, Homo sapiens
  Payload ID: 13097
  Gene Symbol: KCNQ2
  Gene Name: potassium channel, voltage gated KQT-like subfamily Q, member 2
  ENSP ID: ENSP00000349789
IKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 65769 - protein, 872 aa, Homo sapiens [sequence omitted]

SEQ ID NO: 65770 - protein, 844 aa, Homo sapiens
  Payload ID: 13097
  Gene Symbol: KCNQ2
  Gene Name: potassium channel, voltage gated KQT-like subfamily Q, member 2
  Uniprot ID: O43526
  ENSP ID: ENSP00000353668
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 65771 - protein, 766 aa, Homo sapiens
  Payload ID: 13097
  Gene Symbol: KCNQ2
  Gene Name: potassium channel, voltage gated KQT-like subfamily Q, member 2
  ENSP ID: ENSP00000359244
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRIDMIVGPPPPSTPRHKKYPTKGPTAPPRESPQYSPRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLGRAPETRAGQEGSHGGVSH

SEQ ID NO: 65772 - protein, 380 aa, Homo sapiens
  Payload ID: 13097
  Gene Symbol: KCNQ2
  Gene Name: potassium channel, voltage gated KQT-like subfamily Q, member 2
  ENSP ID: ENSP00000485756
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSE

SEQ ID NO: 65773 - protein, 370 aa, Homo sapiens
  Payload ID: 13097
  Gene Symbol: KCNQ2
  Gene Name: potassium channel, voltage gated KQT-like subfamily Q, member 2
  ENSP ID: ENSP00000485832
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSE

SEQ ID NO: 65774 - protein, 153 aa, Homo sapiens
  Payload ID: 13097
  Gene Symbol: KCNQ2
  Gene Name: potassium channel, voltage gated KQT-like subfamily Q, member 2
  ENSP ID: ENSP00000485872
TSALRSLRFLQILRMIRMDRRGGTWKLLGSVVYAHSKELVTAWYIGFLCLILASFLVYLAEKGENDHFDTYADALWWGLPRVASGRPACPQGCEQALRVTRACGPTDHADHHWLRGQVPPDLERQAPCGNLHPHRCLLLRAACSSGAAQAEAL

SEQ ID NO: 65775 - protein, 382 aa, Homo sapiens
  Payload ID: 13097
  Gene Symbol: KCNQ2
  Gene Name: potassium channel, voltage gated KQT-like subfamily Q, member 2
  ENSP ID: ENSP00000486010
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSE

SEQ ID NO: 65776 - protein, 754 aa, Homo sapiens
  Payload ID: 13097
  Gene Symbol: KCNQ2
  Gene Name: potassium channel, voltage gated KQT-like subfamily Q, member 2
  ENSP ID: ENSP00000486040
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRIDMIVGPPPPSTPRHKKYPTKGPTAPPRESPQYSPRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLGRAPETRAGQEGSHGGVSH

SEQ ID NO: 65777 - protein, 645 aa, Homo sapiens
  Payload ID: 13097
  Gene Symbol: KCNQ2
  Gene Name: potassium channel, voltage gated KQT-like subfamily Q, member 2
  ENSP ID: ENSP00000486194
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRDGLQRHAQGRRGLTEGSRTEAPRAGGPAGRHPSARDPHGPRVPAMPAPHAIAVCHPLAVTVAAASPFAPLPLAVCTFVHAPKNIS

SEQ ID NO: 65778 - protein, 410 aa, Homo sapiens
  Payload ID: 13097
  Gene Symbol: KCNQ2
  Gene Name: potassium channel, voltage gated KQT-like subfamily Q, member 2
  ENSP ID: ENSP00000486451
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSKGSPCRGPLCGCCPGRSSQKVSLKDRVFSSPRGVAAKGKGSPQAQTVRRSPSADQSLEDSPSKVPKSWSFGDRSRARQAFRIKGAASRQNSE

SEQ ID NO: 65779 - protein, 295 aa, Homo sapiens
  Payload ID: 13097
  Gene Symbol: KCNQ2
  Gene Name: potassium channel, voltage gated KQT-like subfamily Q, member 2
  ENSP ID: ENSP00000486464
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRYRRRAPATKQLFHFLFSICS

SEQ ID NO: 65780 - protein, 153 aa, Homo sapiens; identical to SEQ ID NO: 65774
  Payload ID: 13097
  Gene Symbol: KCNQ2
  Gene Name: potassium channel, voltage gated KQT-like subfamily Q, member 2
  ENSP ID: ENSP00000486509

SEQ ID NO: 65781 - protein, 195 aa, Homo sapiens
  Payload ID: 13097
  Gene Symbol: KCNQ2
  Gene Name: potassium channel, voltage gated KQT-like subfamily Q, member 2
  ENSP ID: ENSP00000486557
  MOD_RES (1)..(1): Any amino acid
XTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSE

SEQ ID NO: 65782 - protein, 382 aa, Homo sapiens; identical to SEQ ID NO: 65775
  Payload ID: 13097
  Gene Symbol: KCNQ2
  Gene Name: potassium channel, voltage gated KQT-like subfamily Q, member 2
  ENSP ID: ENSP00000486636
  MOD_RES (1)..(1): Any amino acid

SEQ ID NO: 65783 - protein, 854 aa, Homo sapiens
  Payload ID: 13097
  Gene Symbol: KCNQ2
  Gene Name: potassium channel, voltage gated KQT-like subfamily Q, member 2
  Uniprot ID: O43526
  ENSP ID: ENSP00000486706
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 65784 - protein, 382 aa, Homo sapiens; identical to SEQ ID NO: 65775
  Payload ID: 13097
  Gene Symbol: KCNQ2
  Gene Name: potassium channel, voltage gated KQT-like subfamily Q, member 2
  ENSP ID: ENSP00000486949
  MOD_RES (1)..(1): Any amino acid

SEQ ID NO: 65785 - protein, 392 aa, Homo sapiens
  Payload ID: 13097
  Gene Symbol: KCNQ2
  Gene Name: potassium channel, voltage gated KQT-like subfamily Q, member 2
  ENSP ID: ENSP00000487078
  MOD_RES (1)..(1): Any amino acid
XFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSE

SEQ ID NO: 65786 - protein, 382 aa, Homo sapiens; identical to SEQ ID NO: 65775
  Payload ID: 13097
  Gene Symbol: KCNQ2
  Gene Name: potassium channel, voltage gated KQT-like subfamily Q, member 2
  ENSP ID: ENSP00000487095
  MOD_RES (1)..(1): Any amino acid

SEQ ID NO: 65787 - protein, 730 aa, Homo sapiens
  Payload ID: 13097
  Gene Symbol: KCNQ2
  Gene Name: potassium channel, voltage gated KQT-like subfamily Q, member 2
  ENSP ID: ENSP00000487142
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLGRAPETRAGQEGSHGGVSH

SEQ ID NO: 65788 - protein, 179 aa, Homo sapiens
  Payload ID: 13097
  Gene Symbol: KCNQ2
  Gene Name: potassium channel, voltage gated KQT-like subfamily Q, member 2
  ENSP ID: ENSP00000487384
RSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRQEPRLPVQQGTRTGWASGTKPTVAHGGSAGGVWAGPPPHPRRPLSASVVSSQSLF

SEQ ID NO: 65789 - protein, 44 aa, Homo sapiens
  Payload ID: 13097
  Gene Symbol: KCNQ2
  Gene Name: potassium channel, voltage gated KQT-like subfamily Q, member 2
  ENSP ID: ENSP00000487440
RSPSADQSLEDSPSKVPKSWSFGDRSRARQAFRIKGAASRQNSE

SEQ ID NO: 65790 - protein, 229 aa, Homo sapiens
  Payload ID: 13097
  Gene Symbol: KCNQ2
  Gene Name: potassium channel, voltage gated KQT-like subfamily Q, member 2
  ENSP ID: ENSP00000487469
  MOD_RES (1)..(1): Any amino acid
XTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEASLPGEDIVDDKSCPCEFVTEDLTPGLKVSIRAV

SEQ ID NO: 65791 - protein, 364 aa, Homo sapiens
  Payload ID: 13097
  Gene Symbol: KCNQ2
  Gene Name: potassium channel, voltage gated KQT-like subfamily Q, member 2
  ENSP ID: ENSP00000487545
IKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSE

SEQ ID NO: 65792 - protein, 192 aa, Homo sapiens
  Payload ID: 13097
  Gene Symbol: KCNQ2
  Gene Name: potassium channel, voltage gated KQT-like subfamily Q, member 2
  ENSP ID: ENSP00000487563
  MOD_RES (1)..(1): Any amino acid
XRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQVSPGVPRGPAQPLSWSHLVEEWRPLGLWHCPVCGWATALTLCRNLWKERGCEVCVLRNGSNP

SEQ ID NO: 65793 - protein, 872 aa, Homo sapiens
  Payload ID: 13098
  Gene Symbol: KCNQ3
  Gene Name: potassium channel, voltage gated KQT-like subfamily Q, member 3
  Uniprot ID: O43525
  ENSP ID: ENSP00000373648
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 65794 - protein, 860 aa, Homo sapiens
  Payload ID: 13098
  Gene Symbol: KCNQ3
  Gene Name: potassium channel, voltage gated KQT-like subfamily Q, member 3
  ENSP ID: ENSP00000428790
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 65795 - protein, 752 aa, Homo sapiens
  Payload ID: 13098
  Gene Symbol: KCNQ3
  Gene Name: potassium channel, voltage gated KQT-like subfamily Q, member 3
  Uniprot ID: O43525
  ENSP ID: ENSP00000429799
MKPAEHATMFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 65796 - protein, 751 aa, Homo sapiens [sequence omitted]

SEQ ID NO: 65797 - protein, 695 aa, Homo sapiens [sequence omitted]

SEQ ID NO: 65798 - protein, 556 aa, Homo sapiens
  Payload ID: 13099
  Gene Symbol: KCNQ4
  Gene Name: potassium channel, voltage gated KQT-like subfamily Q, member 4
  ENSP ID: ENSP00000406735
  MOD_RES (1)..(1): Any amino acid
XFLLVFSCLVLSVLSTIQEHQELANECLLILEFVMIVVFGLEYIVRVWSAGCCCRYRGWQGRFRFARKPFCVIDFIVFVASVAVIAAGTQGNIFATSALRSMRFLQILRMVRMDRRGGTWKLLGSVVYAHSKELITAWYIGFLVLIFASFLVYLAEKDANSDFSSYADSLWWGTITLTTIGYGDKTPHTWLGRVLAAGFALLGISFFALPAGILGSGFALKVQEQHRQKHFEKRRMPAANLIQAAWRLYSTDMSRAYLTATWYYYDSILPSFSQMFNNKRSFFRIHASWRPSSRMGIKDRIRMGSSQRRTGPSKQHLAPPTMPTSPSSEQVGEATSPTKVQKSWSFNDRTRFRASLRLKPRTSAEDAPSEEVAEEKSYQCELTVDDIMPAVKTVIRSIRILKFLVAKRKFKETLRPYDVKDVIEQYSAGHLDMLGRIKSLQTRVDQIVGRGPGDRKAREKGDKGPSDAEVVDEISMMGRVVKVEKQVQSIEHKLDLLLGFYSRCLRSGTSASLGAVQVPLFDPDITSDYHSPVDHEDISVSAQTLSISRSVSTNMD

SEQ ID NO: 65799 - protein, 641 aa, Homo sapiens
  Payload ID: 13099
  Gene Symbol: KCNQ4
  Gene Name: potassium channel, voltage gated KQT-like subfamily Q, member 4
  Uniprot ID: P56696
  ENSP ID: ENSP00000423756
MAEAPPRRLGLGPPPGDAPRAELVALTAVQSEQGEAGGGGSPRRLGLLGSPLPPGAPLPGPGSGSGSACGQRSSAAHKRYRRLQNWVYNVLERPRGWAFVYHVFIFLLVFSCLVLSVLSTIQEHQELANECLLILEFVMIVVFGLEYIVRVWSAGCCCRYRGWQGRFRFARKPFCVIDFIVFVASVAVIAAGTQGNIFATSALRSMRFLQILRMVRMDRRGGTWKLLGSVVYAHSKELITAWYIGFLVLIFASFLVYLAEKDANSDFSSYADSLWWGTITLTTIGYGDKTPHTWLGRVLAAGFALLGISFFALPAGILGSGFALKVQEQHRQKHFEKRRMPAANLIQAAWRLYSTDMSRAYLTATWYYYDSILPSFSSRMGIKDRIRMGSSQRRTGPSKQHLAPPTMPTSPSSEQVGEATSPTKVQKSWSFNDRTRFRASLRLKPRTSAEDAPSEEVAEEKSYQCELTVDDIMPAVKTVIRSIRILKFLVAKRKFKETLRPYDVKDVIEQYSAGHLDMLGRIKSLQTRVDQIVGRGPGDRKAREKGDKGPSDAEVVDEISMMGRVVKVEKQVQSIEHKLDLLLGFYSRCLRSGTSASLGAVQVPLFDPDITSDYHSPVDHEDISVSAQTLSISRSVSTNMD

SEQ ID NO: 65800 - protein, 951 aa, Homo sapiens
  Payload ID: 13100
  Gene Symbol: KCNQ5
  Gene Name: potassium channel, voltage gated KQT-like subfamily Q, member 5
  Uniprot ID: Q9NR82
  ENSP ID: ENSP00000345055
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSKFCSNKQKLFRMYTSRKQSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 65801 - protein, 932 aa, Homo sapiens [sequence omitted]

SEQ ID NO: 65802 - protein, 951 aa, Homo sapiens [sequence omitted]

SEQ ID NO: 65803 - protein, 427 aa, Homo sapiens
  Payload ID: 13100
  Gene Symbol: KCNQ5
  Gene Name: potassium channel, voltage gated KQT-like subfamily Q, member 5
  Uniprot ID: Q9NR82
  ENSP ID: ENSP00000359419
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRFVISLLLHVCL

SEQ ID NO: 65804 - protein, 932 aa, Homo sapiens
  Payload ID: 13100
  Gene Symbol: KCNQ5
  Gene Name: potassium channel, voltage gated KQT-like subfamily Q, member 5
  Uniprot ID: Q9NR82
  ENSP ID: ENSP00000359425
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 65805 - protein, 923 aa, Homo sapiens [sequence omitted]

SEQ ID NO: 65806 - protein, 942 aa, Homo sapiens [sequence omitted]

SEQ ID NO: 65807 - protein, 97 aa, Homo sapiens
  Payload ID: 13100
  Gene Symbol: KCNQ5
  Gene Name: potassium channel, voltage gated KQT-like subfamily Q, member 5
  ENSP ID: ENSP00000388098
  MOD_RES (1)..(1): Any amino acid
XHTCSPTNQKLSFKERVRMASPRGQSIKSRQASVGDRRSPSTDITAEGSPTKVQKSWSFNDRTRFRPSLRLKSSQPKPVIDDKGHIKINGTVILMYL

SEQ ID NO: 65808 - protein, 90 aa, Homo sapiens
  Payload ID: 13100
  Gene Symbol: KCNQ5
  Gene Name: potassium channel, voltage gated KQT-like subfamily Q, member 5
  ENSP ID: ENSP00000391971
EFVMIVVFGLEFIIRIWSAGCCCRYRGWQGRLRFARKPFCVIGVRNCCVIFSVSSLTPVPYGGGRVDLRKKVYHHPWALLRRILYSILLS

SEQ ID NO: 65809 - protein, 822 aa, Homo sapiens [sequence omitted]

SEQ ID NO: 65810 - protein, 68 aa, Homo sapiens
  Payload ID: 13100
  Gene Symbol: KCNQ5
  Gene Name: potassium channel, voltage gated KQT-like subfamily Q, member 5
  ENSP ID: ENSP00000414829
LEFVMIVVFGLEFIIRIWSAGCCCRYRGWQGRLRFARKPFCVIGEYQSLRYLDYDTNILVFYLLFCNI

SEQ ID NO: 65811 - protein, 923 aa, Homo sapiens
  Payload ID: 13100
  Gene Symbol: KCNQ5
  Gene Name: potassium channel, voltage gated KQT-like subfamily Q, member 5
  Uniprot ID: Q9NR82
  ENSP ID: ENSP00000485743
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 65812 - protein, 822 aa, Homo sapiens
  Payload ID: 13100
  Gene Symbol: KCNQ5
  Gene Name: potassium channel, voltage gated KQT-like subfamily Q, member 5
  Uniprot ID: Q9NR82
  ENSP ID: ENSP00000486187
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 65813 - protein, 494 aa, Homo sapiens
  Payload ID: 13101
  Gene Symbol: KCNF1
  Gene Name: potassium channel, voltage gated modifier subfamily F, member 1
  Uniprot ID: Q9H3M0
  ENSP ID: ENSP00000295082
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 65814 - protein, 513 aa, Homo sapiens
  Payload ID: 13102
  Gene Symbol: KCNG1
  Gene Name: potassium channel, voltage gated modifier subfamily G, member 1
  Uniprot ID: Q9UIX4
  ENSP ID: ENSP00000360626
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 65815 - protein, 258 aa, Homo sapiens
  Payload ID: 13102
  Gene Symbol: KCNG1
  Gene Name: potassium channel, voltage gated modifier subfamily G, member 1
  ENSP ID: ENSP00000394075
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQ

SEQ ID NO: 65816 - protein, 180 aa, Homo sapiens
  Payload ID: 13102
  Gene Symbol: KCNG1
  Gene Name: potassium channel, voltage gated modifier subfamily G, member 1
  ENSP ID: ENSP00000394093
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMV

SEQ ID NO: 65817 - protein, 48 aa, Homo sapiens
  Payload ID: 13102
  Gene Symbol: KCNG1
  Gene Name: potassium channel, voltage gated modifier subfamily G, member 1
  ENSP ID: ENSP00000396058
MTLLPGDNSDYDYSALSCTSDASFHPAFLPQRQAIKGAFYRRAQRLRP

SEQ ID NO: 65818 - protein, 96 aa, Homo sapiens
  Payload ID: 13102
  Gene Symbol: KCNG1
  Gene Name: potassium channel, voltage gated modifier subfamily G, member 1
  ENSP ID: ENSP00000408116
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACT

SEQ ID NO: 65819 - protein, 466 aa, Homo sapiens
  Payload ID: 13103
  Gene Symbol: KCNG2
  Gene Name: potassium channel, voltage gated modifier subfamily G, member 2
  Uniprot ID: Q9UJ96
  ENSP ID: ENSP00000315654
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 65820 - protein, 436 aa, Homo sapiens
  Payload ID: 13104
  Gene Symbol: KCNG3
  Gene Name: potassium channel, voltage gated modifier subfamily G, member 3
  Uniprot ID: Q8TAE7
  ENSP ID: ENSP00000304127
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 65821 - protein, 425 aa, Homo sapiens
  Payload ID: 13104
  Gene Symbol: KCNG3
  Gene Name: potassium channel, voltage gated modifier subfamily G, member 3
  Uniprot ID: Q8TAE7
  ENSP ID: ENSP00000378424
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 65822 - protein, 519 aa, Homo sapiens
  Payload ID: 13105
  Gene Symbol: KCNG4
  Gene Name: potassium channel, voltage gated modifier subfamily G, member 4
  Uniprot ID: Q8TDN1
  ENSP ID: ENSP00000312129
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 65823 - protein, 256 aa, Homo sapiens
  Payload ID: 13105
  Gene Symbol: KCNG4
  Gene Name: potassium channel, voltage gated modifier subfamily G, member 4
  Uniprot ID: Q8TDN1
  ENSP ID: ENSP00000457897
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQVSGL

SEQ ID NO: 65824 - protein, 500 aa, Homo sapiens
  Payload ID: 13106
  Gene Symbol: KCNV1
  Gene Name: potassium channel, voltage gated modifier subfamily V, member 1
  Uniprot ID: Q6PIU1
  ENSP ID: ENSP00000297404
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 65825 - protein, 500 aa, Homo sapiens; identical to SEQ ID NO: 65824
  Payload ID: 13106
  Gene Symbol: KCNV1
  Gene Name: potassium channel, voltage gated modifier subfamily V, member 1
  Uniprot ID: Q6PIU1
  ENSP ID: ENSP00000435954

SEQ ID NO: 65826 - protein, 545 aa, Homo sapiens
  Payload ID: 13107
  Gene Symbol: KCNV2
  Gene Name: potassium channel, voltage gated modifier subfamily V, member 2
  Uniprot ID: Q8TDN2
  ENSP ID: ENSP00000371514
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 65827 - protein, 858 aa, Homo sapiens [sequence omitted]

SEQ ID NO: 65828 - protein, 858 aa, Homo sapiens [sequence omitted]

SEQ ID NO: 65829 - protein, 911 aa, Homo sapiens
  Payload ID: 13109
  Gene Symbol: KCNB2
  Gene Name: potassium channel, voltage gated Shab related subfamily B, member 2
  Uniprot ID: Q92953
  ENSP ID: ENSP00000430846
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 65830 - protein, 495 aa, Homo sapiens
  Payload ID: 13110
  Gene Symbol: KCNA1
  Gene Name: potassium channel, voltage gated shaker related subfamily A, member 1
  Uniprot ID: Q09470
  ENSP ID: ENSP00000371985
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 65831 - protein, 511 aa, Homo sapiens
  Payload ID: 13111
  Gene Symbol: KCNA10
  Gene Name: potassium channel, voltage gated shaker related subfamily A, member 10
  Uniprot ID: Q16322
  ENSP ID: ENSP00000358786
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 65832 - protein, 499 aa, Homo sapiens
  Payload ID: 13112
  Gene Symbol: KCNA2
  Gene Name: potassium channel, voltage gated shaker related subfamily A, member 2
  Uniprot ID: P16389
  ENSP ID: ENSP00000314520
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 65833 - protein, 356 aa, Homo sapiens
  Payload ID: 13112
  Gene Symbol: KCNA2
  Gene Name: potassium channel, voltage gated shaker related subfamily A, member 2
  Uniprot ID: P16389
  ENSP ID: ENSP00000358785
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLERRPLQSQKSKRGRQHLNTSHDCTLGINLVAGMTVQWTRASGPDDRQTPAVTTLHRMY

SEQ ID NO: 65834 - protein, 499 aa, Homo sapiens; identical to SEQ ID NO: 65832
  Payload ID: 13112
  Gene Symbol: KCNA2
  Gene Name: potassium channel, voltage gated shaker related subfamily A, member 2
  Uniprot ID: P16389
  ENSP ID: ENSP00000433109

SEQ ID NO: 65835 - protein, 499 aa, Homo sapiens; identical to SEQ ID NO: 65832
  Payload ID: 13112
  Gene Symbol: KCNA2
  Gene Name: potassium channel, voltage gated shaker related subfamily A, member 2
  Uniprot ID: P16389
  ENSP ID: ENSP00000487785

SEQ ID NO: 65836 - protein, 575 aa, Homo sapiens
  Payload ID: 13113
  Gene Symbol: KCNA3
  Gene Name: potassium channel, voltage gated shaker related subfamily A, member 3
  Uniprot ID: P22001
  ENSP ID: ENSP00000358784
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 65837 - protein, 653 aa, Homo sapiens
  Payload ID: 13114
  Gene Symbol: KCNA4
  Gene Name: potassium channel, voltage gated shaker related subfamily A, member 4
  Uniprot ID: P22459
  ENSP ID: ENSP00000328511
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 65838 - protein, 613 aa, Homo sapiens
  Payload ID: 13115
  Gene Symbol: KCNA5
  Gene Name: potassium channel, voltage gated shaker related subfamily A, member 5
  Uniprot ID: P22460
  ENSP ID: ENSP00000252321
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 65839 - protein, 456 aa, Homo sapiens
  Payload ID: 13116
  Gene Symbol: KCNA7
  Gene Name: potassium channel, voltage gated shaker related subfamily A, member 7
  Uniprot ID: Q96RP8
  ENSP ID: ENSP00000221444
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 65840 - protein, 647 aa, Homo sapiens
  Payload ID: 13117
  Gene Symbol: KCND1
  Gene Name: potassium channel, voltage gated Shal related subfamily D, member 1
  Uniprot ID: Q9NSA2
  ENSP ID: ENSP00000218176
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPSRCRFLRSVMSLIDVVAILPYYIGLLVPKNDDVSGAFVTLRVFRVFRIFKFSRHSQGLRILGYTLKSCASELGFLLFSLTMAIIIFATVMFYAEKGTNKTNFTSIPAAFWYTIVTMTTLGYGDMVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 65841 - protein, 270 aa, Homo sapiens
  Payload ID: 13117
  Gene Symbol: KCND1
  Gene Name: potassium channel, voltage gated Shal related subfamily D, member 1
  Uniprot ID: Q9NSA2
  ENSP ID: ENSP00000365660
MVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 65842 - protein, 133 aa, Homo sapiens
  Payload ID: 13117
  Gene Symbol: KCND1
  Gene Name: potassium channel, voltage gated Shal related subfamily D, member 1
  ENSP ID: ENSP00000413989
  MOD_RES (1)..(1): Any amino acid
XGRGLDRVGVSHNGEEGAALIALLHLLQDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDM

SEQ ID NO: 65843 - protein, 630 aa, Homo sapiens
  Payload ID: 13118
  Gene Symbol: KCND2
  Gene Name: potassium channel, voltage gated Shal related subfamily D, member 2
  Uniprot ID: Q9NZV8
  ENSP ID: ENSP00000333496
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 65844 - protein, 177 aa, Homo sapiens
  Payload ID: 13118
  Gene Symbol: KCND2
  Gene Name: potassium channel, voltage gated Shal related subfamily D, member 2
  ENSP ID: ENSP00000415463
  MOD_RES (1)..(1): Any amino acid
XIQSCGPVPVDKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQP

SEQ ID NO: 65845 - protein, 636 aa, Homo sapiens
  Payload ID: 13119
  Gene Symbol: KCND3
  Gene Name: potassium channel, voltage gated Shal related subfamily D, member 3
  Uniprot ID: Q9UK17
  ENSP ID: ENSP00000306923
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 65846 - protein, 655 aa, Homo sapiens
  Payload ID: 13119
  Gene Symbol: KCND3
  Gene Name: potassium channel, voltage gated Shal related subfamily D, member 3
  Uniprot ID: Q9UK17
  ENSP ID: ENSP00000319591
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 65847 - protein, 636 aa, Homo sapiens; identical to SEQ ID NO: 65845
  Payload ID: 13119
  Gene Symbol: KCND3
  Gene Name: potassium channel, voltage gated Shal related subfamily D, member 3
  Uniprot ID: Q9UK17
  ENSP ID: ENSP00000358711

SEQ ID NO: 65848 - protein, 585 aa, Homo sapiens
  Payload ID: 13120
  Gene Symbol: KCNC1
  Gene Name: potassium channel, voltage gated Shaw related subfamily C, member 1
  Uniprot ID: P48547
  ENSP ID: ENSP00000265969
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 65849 - protein, 511 aa, Homo sapiens
  Payload ID: 13120
  Gene Symbol: KCNC1
  Gene Name: potassium channel, voltage gated Shaw related subfamily C, member 1
  Uniprot ID: P48547
  ENSP ID: ENSP00000368785
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 65850 - protein, 613 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000298972
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 65851 - protein, 558 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000319877
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSDNCKEVVITGYTQAEARSLT

SEQ ID NO: 65852 - protein, 618 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000376966
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGIRNGHSILHHLDNGTKCHYLRIIF

SEQ ID NO: 65853 - protein, 583 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000438423
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSGYEKSRSLNNIAGLAGNALRLSPVTSPYNSPCPLRRSRSPIPSIL

SEQ ID NO: 65854 - protein, 629 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000448301
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKVLYRIYHGLLTAEKGTVEFSHTKDYTGNRLLLLNVP

SEQ ID NO: 65855 - protein, 638 aa, Homo sapiens
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000449253
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 65856 - protein, 613 aa, Homo sapiens; identical to SEQ ID NO: 65850
  Payload ID: 13121
  Gene Symbol: KCNC2
  Gene Name: potassium channel, voltage gated Shaw related subfamily C, member 2
  Uniprot ID: Q96PR1
  ENSP ID: ENSP00000449941

SEQ ID NO: 65857 - protein, 728 aa, Homo sapiens
  Payload ID: 13122
  Gene Symbol: KCNC3
  Gene Name: potassium channel, voltage gated Shaw related subfamily C, member 3
  ENSP ID: ENSP00000366158
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKALVTA

SEQ ID NO: 65858 - protein, 44 aa, Homo sapiens
  Payload ID: 13122
  Gene Symbol: KCNC3
  Gene Name: potassium channel, voltage gated Shaw related subfamily C, member 3
  ENSP ID: ENSP00000432438
MSPEDKSPITPGSRGRYSRDRACFLLTDYAPSPDGSIRKALVTA

SEQ ID NO: 65859 - protein, 757 aa, Homo sapiens
  Payload ID: 13122
  Gene Symbol: KCNC3
  Gene Name: potassium channel, voltage gated Shaw related subfamily C, member 3
  Uniprot ID: Q14003
  ENSP ID: ENSP00000434241
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 65860 - protein, 635 aa, Homo sapiens
  Payload ID: 13123
  Gene Symbol: KCNC4
  Gene Name: potassium channel, voltage gated Shaw related subfamily C, member 4
  Uniprot ID: Q03721
  ENSP ID: ENSP00000358802
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKGTFVLRDLPLQHSPEAACPPTAGTLFLPH

SEQ ID NO: 65861 - protein, 624 aa, Homo sapiens
  Payload ID: 13123
  Gene Symbol: KCNC4
  Gene Name: potassium channel, voltage gated Shaw related subfamily C, member 4
  ENSP ID: ENSP00000388029
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKEGNVEPKACVPVSHTCAL

SEQ ID NO: 65862 - protein, 626 aa, Homo sapiens
  Payload ID: 13123
  Gene Symbol: KCNC4
  Gene Name: potassium channel, voltage gated Shaw related subfamily C, member 4
  Uniprot ID: Q03721
  ENSP ID: ENSP00000393655
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKETCQDALSSNYAQAEVLTLS

SEQ ID NO: 65863 - protein, 635 aa, Homo sapiens; identical to SEQ ID NO: 65860
  Payload ID: 13123
  Gene Symbol: KCNC4
  Gene Name: potassium channel, voltage gated Shaw related subfamily C, member 4
  Uniprot ID: Q03721
  ENSP ID: ENSP00000436656

SEQ ID NO: 65864 - protein, 401 aa, Homo sapiens
  Payload ID: 13124
  Gene Symbol: KCNAB1
  Gene Name: potassium channel, voltage gated subfamily A regulatory beta subunit 1
  Uniprot ID: Q14722
  ENSP ID: ENSP00000305858
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 65865 - protein, 372 aa, Homo sapiens
  Payload ID: 13124
  Gene Symbol: KCNAB1
  Gene Name: potassium channel, voltage gated subfamily A regulatory beta subunit 1
  ENSP ID: ENSP00000374285
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 65866 - protein, 390 aa, Homo sapiens
  Payload ID: 13124
  Gene Symbol: KCNAB1
  Gene Name: potassium channel, voltage gated subfamily A regulatory beta subunit 1
  ENSP ID: ENSP00000374287
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 65867 - protein, 81 aa, Homo sapiens
  Payload ID: 13124
  Gene Symbol: KCNAB1
  Gene Name: potassium channel, voltage gated subfamily A regulatory beta subunit 1
  ENSP ID: ENSP00000418048
IACTEHNLKSRNGEDRLLSKQSSTAPNVVNAARAKFRTVAIIARSLGTFTPQHHISLKESTAKQTGMKYRNMGDIWRSNFR

SEQ ID NO: 65868 - protein, 408 aa, Homo sapiens
  Payload ID: 13124
  Gene Symbol: KCNAB1
  Gene Name: potassium channel, voltage gated subfamily A regulatory beta subunit 1
  Uniprot ID: Q14722
  ENSP ID: ENSP00000418956
MHLYKPACADIPSPKLGLPKSSESALKCRWHLAVTKTQPQAACKPVRPSGAAEQKYVEKFLRVHGISLQETTRAETGMAYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 65869 - protein, 419 aa, Homo sapiens
  Payload ID: 13124
  Gene Symbol: KCNAB1
  Gene Name: potassium channel, voltage gated subfamily A regulatory beta subunit 1
  Uniprot ID: Q14722
  ENSP ID: ENSP00000419952
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 65870 - protein, 177 aa, Homo sapiens
  Payload ID: 13124
  Gene Symbol: KCNAB1
  Gene Name: potassium channel, voltage gated subfamily A regulatory beta subunit 1
  ENSP ID: ENSP00000420221
MQLLLWGGRRVASAIHRCLSYSLHCLFQRYEVKTRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMA

SEQ ID NO: 65871 - protein, 128 aa, Homo sapiens
  Payload ID: 13124
  Gene Symbol: KCNAB1
  Gene Name: potassium channel, voltage gated subfamily A regulatory beta subunit 1
  ENSP ID: ENSP00000420755
MWLSSKAMLRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGT

SEQ ID NO: 65872 - protein, 304 aa, Homo sapiens [sequence omitted]

SEQ ID NO: 65873 - protein, 367 aa, Homo sapiens
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000164247
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 65874 - protein, 353 aa, Homo sapiens
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000318772
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 65875 - protein, 367 aa, Homo sapiens; identical to SEQ ID NO: 65873
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000340824

SEQ ID NO: 65876 - protein, 415 aa, Homo sapiens
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000367323
MLSMTYSESLRSVSSRCHSEWALHPVRQTDTLELQRLREVRAAAQARNMESFLRMHGLSLDGCTAQRTGMKYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEGDPFSSSKSRTFIIEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 65877 - protein, 353 aa, Homo sapiens; identical to SEQ ID NO: 65874
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000367332

SEQ ID NO: 65878 - protein, 367 aa, Homo sapiens; identical to SEQ ID NO: 65873
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000367337

SEQ ID NO: 65879 - protein, 173 aa, Homo sapiens
  Payload ID: 13125
  Gene Symbol: KCNAB2
  Gene Name: potassium channel, voltage gated subfamily A regulatory beta subunit 2
  ENSP ID: ENSP00000367351
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRQRGERAGQARVTPPCSLGRRARDASKSAGAGCHLQAQACVPSSTQALQTTRGRAPLKPPPPLAS

SEQ ID NO: 65880 - protein, 253 aa, Homo sapiens
  Payload ID: 13125
  Gene Symbol: KCNAB2
  Gene Name: potassium channel, voltage gated subfamily A regulatory beta subunit 2
  ENSP ID: ENSP00000374283
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSG

SEQ ID NO: 65881 - protein, 300 aa, Homo sapiens
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000396167
MAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 65882 - protein, 51 aa, Homo sapiens
  Payload ID: 13125
  Gene Symbol: KCNAB2
  Gene Name: potassium channel, voltage gated subfamily A regulatory beta subunit 2
  ENSP ID: ENSP00000398395
MYPESTTGSPARLSLRQTGSPGMIYSTRYGSPKRQLQFYRNLGKSGLRVSC

SEQ ID NO: 65883 - protein, 254 aa, Homo sapiens
  Payload ID: 13125
  Gene Symbol: KCNAB2
  Gene Name: potassium channel, voltage gated subfamily A regulatory beta subunit 2
  ENSP ID: ENSP00000400285
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLK

SEQ ID NO: 65884 - protein, 162 aa, Homo sapiens
  Payload ID: 13125
  Gene Symbol: KCNAB2
  Gene Name: potassium channel, voltage gated subfamily A regulatory beta subunit 2
  ENSP ID: ENSP00000464860
  MOD_RES (1)..(1): Any amino acid
XTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRIFAASQPLRSSLFPSVRGNIRSSYKVGPPSSLPSKCHSESQCQGEPPPPPPWIPDTPSSCPIKFVFWQL

SEQ ID NO: 65885 - protein, 122 aa, Homo sapiens
  Payload ID: 13125
  Gene Symbol: KCNAB2
  Gene Name: potassium channel, voltage gated subfamily A regulatory beta subunit 2
  ENSP ID: ENSP00000465785
YAAGKAEVVLGNIIKKKGWRIFAASQPLRSSLFPSVRGCVWDRSGRAILRVSGPKSVNHPPSSGRDVSHSSGKWSPPAQTGERSPGVMEPKGRRSGAIHPSLPGAYGPFPGQGPHPPWDQLG

SEQ ID NO: 65886 - protein, 395 aa, Homo sapiens
  Payload ID: 13125
  Gene Symbol: KCNAB2
  Gene Name: potassium channel, voltage gated subfamily A regulatory beta subunit 2
  Uniprot ID: Q13303
  ENSP ID: ENSP00000473602
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVRVRGPAGQRAHPSPSPVQCILPGSSCVPGSVLGTQDAPVNHQSCAPGELAFQQEQT

SEQ ID NO: 65887 - protein, 404 aa, Homo sapiens
  Payload ID: 13126
  Gene Symbol: KCNAB3
  Gene Name: potassium channel, voltage gated subfamily A regulatory beta subunit 3
  Uniprot ID: O43448
  ENSP ID: ENSP00000302719
MQVSIACTEQNLRSRSSEDRLCGPRPGPGGGNGGPAGGGHGNPPGGGGSGPKARAALVPRPPAPAGALRESTGRGTGMKYRNLGKSGLRVSCLGLGTWVTFGSQISDETAEDVLTVAYEHGVNLFDTAEVYAAGKAERTLGNILKSKGWRRSSYVITTKIFWGGQAETERGLSRKHIIEGLRGSLERLQLGYVDIVFANRSDPNCPMEEIVRAMTYVINQGLALYWGTSRWGAAEIMEAYSMARQFNLIPPVCEQAEHHLFQREKVEMQLPELYHKIGVGSVTWYPLACGLITSKYDGRVPDTCRASIKGYQWLKDKVQSEDGKKQQAKVMDLLPVAHQLGCTVAQLAIAWCLRSEGVSSVLLGVSSAEQLIEHLGALQVLSQLTPQTVMEIDGLLGNKPHSKK

SEQ ID NO: 65888 - protein, 42 aa, Homo sapiens
  Payload ID: 13126
  Gene Symbol: KCNAB3
  Gene Name: potassium channel, voltage gated subfamily A regulatory beta subunit 3
  ENSP ID: ENSP00000458237
MQVSIACTEQNLRSRSSEDRLCGPRPGPGGGPQSAFPPGPSA

SEQ ID NO: 65889 - protein, 101 aa, Homo sapiens
  Payload ID: 13126
  Gene Symbol: KCNAB3
  Gene Name: potassium channel, voltage gated subfamily A regulatory beta subunit 3
  ENSP ID: ENSP00000461290
MQVSIACTEQNLRSRSSEDRLCGPRPGPGGGNGGPAGGGHGNPPGGGGSGPKARAALVPRPPAPAGALRESTGRGTGMKYRYGGGRAAHPFRFPFGTPETA

SEQ ID NO: 65890 - protein, 129 aa, Homo sapiens
  Payload ID: 13127
  Gene Symbol: KCNE1
  Gene Name: potassium channel, voltage gated subfamily E regulatory beta subunit 1
  Uniprot ID: P15382
  ENSP ID: ENSP00000337255
MILSNTTAVTPFLTKLWQETVQQGGNMSGLARRSPRSSDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 65891 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000382225

SEQ ID NO: 65892 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000382226

SEQ ID NO: 65893 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000382228

SEQ ID NO: 65894 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000412498

SEQ ID NO: 65895 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000416258

SEQ ID NO: 65896 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000478215

SEQ ID NO: 65897 - protein, 129 aa, Homo sapiens; identical to SEQ ID NO: 65890
  Payload ID: 13127
  Gene Symbol: KCNE1
  Gene Name: potassium channel, voltage gated subfamily E regulatory beta subunit 1
  Uniprot ID: P15382
  ENSP ID: ENSP00000483895

SEQ ID NO: 65898 - protein, 123 aa, Homo sapiens
  Payload ID: 13128
  Gene Symbol: KCNE2
  Gene Name: potassium channel, voltage gated subfamily E regulatory beta subunit 2
  Uniprot ID: Q9Y6J6
  ENSP ID: ENSP00000290310
MSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 65899 - protein, 103 aa, Homo sapiens
  Payload ID: 13129
  Gene Symbol: KCNE3
  Gene Name: potassium channel, voltage gated subfamily E regulatory beta subunit 3
  Uniprot ID: Q9Y6H6
  ENSP ID: ENSP00000310557
METTNGTETWYESLHAVLKALNATLHSNLLCRPGPGLGPDNQTEERRASLPGRDDNSYMYILFVMFLFAVTVGSLILGYTRSRKVDKRSDPYHVYIKNRVSMI

SEQ ID NO: 65900 - protein, 99 aa, Homo sapiens
  Payload ID: 13129
  Gene Symbol: KCNE3
  Gene Name: potassium channel, voltage gated subfamily E regulatory beta subunit 3
  ENSP ID: ENSP00000431739
METTNGTETWYESLHAVLKALNATLHSNLLCRPGPGLGPDNQTEERRASLPGRDDNSYMYILFVMFLFAVTVGSLILGYTRSRKVDKRSDPYHVYIKNR

SEQ ID NO: 65901 - protein, 103 aa, Homo sapiens; identical to SEQ ID NO: 65899
  Payload ID: 13129
  Gene Symbol: KCNE3
  Gene Name: potassium channel, voltage gated subfamily E regulatory beta subunit 3
  Uniprot ID: Q9Y6H6
  ENSP ID: ENSP00000433633

SEQ ID NO: 65902 - protein, 52 aa, Homo sapiens
  Payload ID: 13129
  Gene Symbol: KCNE3
  Gene Name: potassium channel, voltage gated subfamily E regulatory beta subunit 3
  ENSP ID: ENSP00000433697
METTNGTETWYESLHAVLKALNATLHSNLLCRPGPGLGPDNQTEERRASLPG

SEQ ID NO: 65903 - protein, 49 aa, Homo sapiens
  Payload ID: 13129
  Gene Symbol: KCNE3
  Gene Name: potassium channel, voltage gated subfamily E regulatory beta subunit 3
  ENSP ID: ENSP00000434890
METTNGTETWYESLHAVLKALNATLHSNLLCRPGPGLGPDNQTEERRAS

SEQ ID NO: 65904 - protein, 12 aa, Homo sapiens
  Payload ID: 13129
  Gene Symbol: KCNE3
  Gene Name: potassium channel, voltage gated subfamily E regulatory beta subunit 3
  ENSP ID: ENSP00000435539
METTNGTETWYE

SEQ ID NO: 65905 - protein, 221 aa, Homo sapiens
  Payload ID: 13130
  Gene Symbol: KCNE4
  Gene Name: potassium channel, voltage gated subfamily E regulatory beta subunit 4
  Uniprot ID: Q8WWG9
  ENSP ID: ENSP00000281830
MHFLTIYPNCSSGVVRAQSRTEQKNPLGLDDLGIQNLGQTVSLAPAVEAASMLKMEPLNSTHPGTAASSSPLESRAAGGGSGNGNEYFYILVVMSFYGIFLIGIMLGYMKSKRREKKSSLLLLYKDEERLWGEAMKPLPVVSGLRSVQVPLMLNMLQESVAPALSCTLCSMEGDSVSSESSSPDVHLTIQEEGADDELEETSETPLNESSEGSSENIHQNS

SEQ ID NO: 65906 - protein, 142 aa, Homo sapiens
  Payload ID: 13131
  Gene Symbol: KCNE5
  Gene Name: potassium channel, voltage gated subfamily E regulatory beta subunit 5
  Uniprot ID: Q9UJ90
  ENSP ID: ENSP00000361173
MNCSESQRLRTLLSRLLLELHHRGNASGLGAGPRPSMGMGVVPDPFVGREVTSAKGDDAYLYILLIMIFYACLAGGLILAYTRSRKLVEAKDEPSQACAEHEWAPGGALTADAEAAAGSQAEGRRQLASEGLPALAQGAERV

SEQ ID NO: 65907 - protein, 529 aa, Homo sapiens; identical to SEQ ID NO: 65261
  Payload ID: 13132
  Gene Symbol:
  Gene Name: Potassium voltage-gated channel subfamily A member 6  [Source:UniProtKB/Swiss-Prot
  Acc:P17658]
  Uniprot ID: P17658
  ENSP ID: ENSP00000280684

SEQ ID NO: 65908 - protein, 526 aa, Homo sapiens
  Payload ID: 13133
  Gene Symbol: KCNS1
  Gene Name: potassium voltage-gated channel, modifier subfamily S, member 1
  Uniprot ID: Q96KK3
  ENSP ID: ENSP00000307694
MLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 65909 - protein, 526 aa, Homo sapiens; identical to SEQ ID NO: 65908
  Payload ID: 13133
  Gene Symbol: KCNS1
  Gene Name: potassium voltage-gated channel, modifier subfamily S, member 1
  Uniprot ID: Q96KK3
  ENSP ID: ENSP00000445595

SEQ ID NO: 65910 - protein, 477 aa, Homo sapiens
  Payload ID: 13134
  Gene Symbol: KCNS2
  Gene Name: potassium voltage-gated channel, modifier subfamily S, member 2
  Uniprot ID: Q9ULS6
  ENSP ID: ENSP00000287042
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 65911 - protein, 477 aa, Homo sapiens; identical to SEQ ID NO: 65910
  Payload ID: 13134
  Gene Symbol: KCNS2
  Gene Name: potassium voltage-gated channel, modifier subfamily S, member 2
  Uniprot ID: Q9ULS6
  ENSP ID: ENSP00000430712

SEQ ID NO: 65912 - protein, 491 aa, Homo sapiens
  Payload ID: 13135
  Gene Symbol: KCNS3
  Gene Name: potassium voltage-gated channel, modifier subfamily S, member 3
  Uniprot ID: Q9BQ31
  ENSP ID: ENSP00000305824
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHTFITSLSSVGIVVSDPDSTDASSIEDNEDICNTTSLENCTAK

SEQ ID NO: 65913 - protein, 491 aa, Homo sapiens; identical to SEQ ID NO: 65912
  Payload ID: 13135
  Gene Symbol: KCNS3
  Gene Name: potassium voltage-gated channel, modifier subfamily S, member 3
  Uniprot ID: Q9BQ31
  ENSP ID: ENSP00000385968

SEQ ID NO: 65914 - protein, 74 aa, Homo sapiens
  Payload ID: 13135
  Gene Symbol: KCNS3
  Gene Name: potassium voltage-gated channel, modifier subfamily S, member 3
  ENSP ID: ENSP00000400098
MVFGEFFHRPGQDEELVNLNVGGFKQSVDQSTLLRFPHTRLGKLLTCHSEEAILELCDDYSVADKEYYFDRNPS

SEQ ID NO: 65915 - protein, 301 aa, Homo sapiens
  Payload ID: 13136
  Gene Symbol: POTEB
  Gene Name: POTE ankyrin domain family, member B
  ENSP ID: ENSP00000457443
MVAEVCSMPAASAVKKPFDLRSKMGKWCHHRFPCCRGSGTSNVGTSGDHDDSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRICELLSDYKEKQMLKISSENSNPENVSRTRNK

SEQ ID NO: 65916 - protein, 544 aa, Homo sapiens
  Payload ID: 13136
  Gene Symbol: POTEB
  Gene Name: POTE ankyrin domain family, member B
  ENSP ID: ENSP00000457689
MVAEVCSMPAASAVKKPFDLRSKMGKWCHHRFPCCRGSGTSNVGTSGDHDDSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRKSRKPENQQFPDTENEEYHSDEQNDTQKQLSEEQNTGISQDEILTNKQKQIEVAEKEMNSELSLSHKKEEDLLRENSMLREEIAKLRLELDETKHQNQLRENKILEEIESVKEKLLKTIQLNEEALTKTSI

SEQ ID NO: 65917 - protein, 301 aa, Homo sapiens; identical to SEQ ID NO: 65915
  Payload ID: 13137
  Gene Symbol: POTEB2
  Gene Name: POTE ankyrin domain family, member B2
  ENSP ID: ENSP00000454944

SEQ ID NO: 65918 - protein, 544 aa, Homo sapiens; identical to SEQ ID NO: 65916
  Payload ID: 13137
  Gene Symbol: POTEB2
  Gene Name: POTE ankyrin domain family, member B2
  Uniprot ID: H3BUK9
  ENSP ID: ENSP00000456953

SEQ ID NO: 65919 - protein, 581 aa, Homo sapiens; identical to SEQ ID NO: 1163
  Payload ID: 13138
  Gene Symbol: POTEB3
  Gene Name: POTE ankyrin domain family, member B3
  ENSP ID: ENSP00000479963

SEQ ID NO: 65920 - protein, 581 aa, Homo sapiens
  Payload ID: 13138
  Gene Symbol: POTEB3
  Gene Name: POTE ankyrin domain family, member B3
  Uniprot ID: A0JP26
  ENSP ID: ENSP00000483103
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRKSRKPENQQFPDTENEEYHSDEQNDTQKQLSEEQNTGISQDEILTNKQKQIEVAEKEMNSKLSLSHKKEEDLLRENSMLREEIAMLRLELDETKHQNQLRENKILEEIESVKEKLLKAIQLNEEALTKTSI

SEQ ID NO: 65921 - protein, 381 aa, Homo sapiens
  Payload ID: 13138
  Gene Symbol: POTEB3
  Gene Name: POTE ankyrin domain family, member B3
  ENSP ID: ENSP00000483189
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPGKEAEE

SEQ ID NO: 65922 - protein, 381 aa, Homo sapiens; identical to SEQ ID NO: 1164
  Payload ID: 13138
  Gene Symbol: POTEB3
  Gene Name: POTE ankyrin domain family, member B3
  ENSP ID: ENSP00000484709

SEQ ID NO: 65923 - protein, 384 aa, Homo sapiens
  Payload ID: 13138
  Gene Symbol: POTEB3
  Gene Name: POTE ankyrin domain family, member B3
  ENSP ID: ENSP00000485523
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPENVSRTRNK

SEQ ID NO: 65924 - protein, 384 aa, Homo sapiens
  Payload ID: 13138
  Gene Symbol: POTEB3
  Gene Name: POTE ankyrin domain family, member B3
  ENSP ID: ENSP00000485729
MVAEVCSMPAASAVKKPFDLRSKMGKWCHHRFPCCRGSGKSNMGTSGDHDDSFMKTLRSKMGKCCHHCFPCCRGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRTALILAVCCGSASIVNLLLEQNVDVSSQDLSGQTAREYAVSSHHHVICELLSDYKEKQMLKISSENSNPENVSRTRNK

SEQ ID NO: 65925 - protein, 266 aa, Homo sapiens
  Payload ID: 13138
  Gene Symbol: POTEB3
  Gene Name: POTE ankyrin domain family, member B3
  ENSP ID: ENSP00000486649
  MOD_RES (1)..(1): Any amino acid
XGSGTSNVGTSGDHDNSFMKTLRSKMGKWCCHCFPCCRGSGKSNVGTWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADGNIQDEYGNTALHYAIYNEDKLMAKALLLYGADIESKNKCGLTPLLLGVHEQKQEVVKFLIKKKANLNALDRYGRICELLSDYKEKQMLKISSENSNPENVSRTRNK

SEQ ID NO: 65926 - protein, 542 aa, Homo sapiens
  Payload ID: 13139
  Gene Symbol: POTEC
  Gene Name: POTE ankyrin domain family, member C
  Uniprot ID: B2RU33
  ENSP ID: ENSP00000351856
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEKKMNSELSLSHKKEEDLLRENSMLQEEIAMLISGDWN

SEQ ID NO: 65927 - protein, 384 aa, Homo sapiens
  Payload ID: 13139
  Gene Symbol: POTEC
  Gene Name: POTE ankyrin domain family, member C
  ENSP ID: ENSP00000421410
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPENVSRTRNK

SEQ ID NO: 65928 - protein, 586 aa, Homo sapiens
  Payload ID: 13139
  Gene Symbol: POTEC
  Gene Name: POTE ankyrin domain family, member C
  ENSP ID: ENSP00000478950
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEKKMNSELSLSHKKEEDLLRENSMLQEEIAMLILELELDETKHQNQLRENKILEEIESVKEKTDKLLRAMQLNEEALTKTNI

SEQ ID NO: 65929 - protein, 381 aa, Homo sapiens
  Payload ID: 13139
  Gene Symbol: POTEC
  Gene Name: POTE ankyrin domain family, member C
  ENSP ID: ENSP00000481213
MVTEVCSMPAASAVKKPFDLRSKMGKWFHHRFPCCKGSGKSNMGTSGDHDDSFMKMLRSKMGKCCHHCFPCCRGSGTSNVGTSGDHDNSFMKTLRSKMGKWCCHCFPCCRGSGKSNVGAWGDYDDSAFMEPRYHVRREDLDKLHRAAWWGKVPRKDLIVMLRDTDMNKRDKQKRTALHLASANGNSEVVQLLLDRRCQLNVLDNKKRTALIKAVQCQEDECVLMLLEHGADQNIPDEYGNTTLHYAVHNEDKLMAKALLLYGADIESKNKCGLTPLLLGVHEQKQQVVKFLIKKKANLNALDRYGRTALILAVCCGSASIVNLLLEQNVDVSSQDLSGQTAREYAVSSHHHVICELLSDYKEKQMLKISSENSNPGKEAEE

SEQ ID NO: 65930 - protein, 584 aa, Homo sapiens
  Payload ID: 13140
  Gene Symbol: POTED
  Gene Name: POTE ankyrin domain family, member D
  Uniprot ID: Q86YR6
  ENSP ID: ENSP00000299443
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAMLRLELDETKHQNQLRENKILEEIESVKEKTDKLLRAMQLNEEALTKTNI

SEQ ID NO: 65931 - protein, 381 aa, Homo sapiens
  Payload ID: 13140
  Gene Symbol: POTED
  Gene Name: POTE ankyrin domain family, member D
  ENSP ID: ENSP00000484512
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPGKEAEE

SEQ ID NO: 65932 - protein, 1075 aa, Homo sapiens
  Payload ID: 13141
  Gene Symbol: POTEE
  Gene Name: POTE ankyrin domain family, member E
  Uniprot ID: Q6S8J3
  ENSP ID: ENSP00000439189
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQELKLTSEEESQRFKGSENSQPEKMSQELEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDVLHENSTLREEIAMLRLELDTMKHQSQLREKKYLEDIESVKKKNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPILLTEAPLNPKANREKMTQIMFETFNTPAMYVAIQAVPSLYTSGRTTGIVMDSGDGVTHTVPIYEGNALPHATLRLDLAGRELPDYLMKILTERGYRFTTMAEREIVRDIKEKLCYVALDFEQEMATAASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCF

SEQ ID NO: 65933 - protein, 394 aa, Homo sapiens
  Payload ID: 13141
  Gene Symbol: POTEE
  Gene Name: POTE ankyrin domain family, member E
  Uniprot ID: Q6S8J3
  ENSP ID: ENSP00000443049
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKVCSSQLYQHEAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPENVSRTRNK

SEQ ID NO: 65934 - protein, 376 aa, Homo sapiens
  Payload ID: 13141
  Gene Symbol: POTEE
  Gene Name: POTE ankyrin domain family, member E
  Uniprot ID: Q6S8J3
  ENSP ID: ENSP00000477649
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPG

SEQ ID NO: 65935 - protein, 508 aa, Homo sapiens
  Payload ID: 13141
  Gene Symbol: POTEE
  Gene Name: POTE ankyrin domain family, member E
  ENSP ID: ENSP00000483137
MVVEVDSMPAASSVKKPFGLRSKMGKWCCRCFPCYRESGKSNVGTSGDHDDSAMKTLRSKMGKWCHHCFPCCRGSGKSNVGASGDHDDSAMKTLRNKMGKWCCHCFPCCRGSGKSKVGAWGDYDDSAFMEPRYHVRGEDLDKLHRAAWWGKVPRKDLIVMLRDTDVNKKDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQELKLTSEEESQRFKGSENSQPEKMSQELEINKDGDRKVEEEMKKHGSTHVGFPENLTNGATAGNGDDGLIPPRKSRTPESQQFPDTENEEYHSDEQNDTQKQFCEEQNTGILHDEILIHEEKQIEVVENEF

SEQ ID NO: 65936 - protein, 376 aa, Homo sapiens; identical to SEQ ID NO: 65934
  Payload ID: 13141
  Gene Symbol: POTEE
  Gene Name: POTE ankyrin domain family, member E
  Uniprot ID: Q6S8J3
  ENSP ID: ENSP00000485683

SEQ ID NO: 65937 - protein, 1075 aa, Homo sapiens
  Payload ID: 13142
  Gene Symbol: POTEF
  Gene Name: POTE ankyrin domain family, member F
  Uniprot ID: A5A3E0
  ENSP ID: ENSP00000350052
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHRSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQLREKKYLEDIESVKKRNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPVLLTEATLNPKANREKMTQIMFETFNTPAMYVAIQAVLSLYTSGRTTGIVMDSGDGVTHTVPIYEGNALPHATLRLDLAGRELPDYLMKILTEHGYRFTTMAEREIVRDIKEKLCYVALDFEQEMATVASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCL

SEQ ID NO: 65938 - protein, 508 aa, Homo sapiens
  Payload ID: 13142
  Gene Symbol: POTEF
  Gene Name: POTE ankyrin domain family, member F
  ENSP ID: ENSP00000355012
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDRKVEEEMKKHRSTHVGFPENLTNGATAGNGDDGLIPPRKSRTPESQQFPDTENEEYHSDEQNDTQKQFCEEQNTGILHDEILIHEEKQIEVVENEF

SEQ ID NO: 65939 - protein, 1075 aa, Homo sapiens; identical to SEQ ID NO: 65937
  Payload ID: 13142
  Gene Symbol: POTEF
  Gene Name: POTE ankyrin domain family, member F
  Uniprot ID: A5A3E0
  ENSP ID: ENSP00000386786

SEQ ID NO: 65940 - protein, 394 aa, Homo sapiens
  Payload ID: 13142
  Gene Symbol: POTEF
  Gene Name: POTE ankyrin domain family, member F
  ENSP ID: ENSP00000486700
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKVCSSQLYQHEAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPENVSRTRNK

SEQ ID NO: 65941 - protein, 322 aa, Homo sapiens
  Payload ID: 13143
  Gene Symbol: POTEG
  Gene Name: POTE ankyrin domain family, member G
  Uniprot ID: Q6S5H5
  ENSP ID: ENSP00000450807
MVAEAGSMPAASSVKKPFGLRSKMGKWCRHCFPWCRGSGKSNVGTSGDHDDSAMKTLRSKMGKWCRHCFPWCRGSSKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCREDECALMLLEHGTDPNIPDEYGNTALHYAIYNEDKLMAKALLLYGADIESKNKIESHSVSQAGVQWCDHSSLQPRPPEAQMVLQPQPQLFFSFFLFIFIFIFIFF

SEQ ID NO: 65942 - protein, 508 aa, Homo sapiens
  Payload ID: 13143
  Gene Symbol: POTEG
  Gene Name: POTE ankyrin domain family, member G
  Uniprot ID: Q6S5H5
  ENSP ID: ENSP00000450853
MVAEAGSMPAASSVKKPFGLRSKMGKWCRHCFPWCRGSGKSNVGTSGDHDDSAMKTLRSKMGKWCRHCFPWCRGSSKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCREDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHNVICQLLSDYKEKQMLKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHSDEQNDTQKQLSEEQNTGILQDEILIHEEKQIEVAENEF

SEQ ID NO: 65943 - protein, 486 aa, Homo sapiens
  Payload ID: 13143
  Gene Symbol: POTEG
  Gene Name: POTE ankyrin domain family, member G
  Uniprot ID: Q6S5H5
  ENSP ID: ENSP00000482662
MVAEAGSMPAASSVKKPFGLRSKMGKWCRHCFPWCRGSGKSNVGTSGDHDDSAMKTLRSKMGKWCRHCFPWCRGSSKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCREDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHNVICQLLSDYKEKQMLKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHRDFSGHPNFPTTLPIKQ

SEQ ID NO: 65944 - protein, 545 aa, Homo sapiens
  Payload ID: 13144
  Gene Symbol: POTEH
  Gene Name: POTE ankyrin domain family, member H
  Uniprot ID: Q6S545
  ENSP ID: ENSP00000340610
MVAEAGSMPAASSVKKPFGLRSKMGKWCRHCFAWCRGSGKSNVGTSGDHDDSAMKTLRSKMGKWCCHCFPWCRGSGKSNVGTSGDHDDSAMKTLRSKMGKWCCHCFPCCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLTNGATADNGDDGLIPPRKSRTPESQQFPDTENEQYHSDEQNDTQKQLSEEQNTGILQDEILIHEEKQIEVAENEF

SEQ ID NO: 65945 - protein, 303 aa, Homo sapiens
  Payload ID: 13144
  Gene Symbol: POTEH
  Gene Name: POTE ankyrin domain family, member H
  ENSP ID: ENSP00000442107
LRSKMGKWCCHCFPWCRGSGKSNVGTSGDHDDSAMKTLRSKMGKWCCHCFPCCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKIESHSVSQAGVQWCDHSSLQPRPPEAQMVLQPQPQLFFSFFLFIFIFIFIFF

SEQ ID NO: 65946 - protein, 508 aa, Homo sapiens
  Payload ID: 13144
  Gene Symbol: POTEH
  Gene Name: POTE ankyrin domain family, member H
  ENSP ID: ENSP00000477748
MVAEAGSMPAASSVKKPFGLRSKMGKWCRHCFAWCRGSGKSNVGTSGDHDDSAMKTLRSKMGKWCCHCFPWCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLTNGATADNGDDGLIPPRKSRTPESQQFPDTENEQYHSDEQNDTQKQLSEEQNTGILQDEILIHEEKQIEVAENEF

SEQ ID NO: 65947 - protein, 1075 aa, Homo sapiens
  Payload ID: 13145
  Gene Symbol: POTEI
  Gene Name: POTE ankyrin domain family, member I
  Uniprot ID: P0CG38
  ENSP ID: ENSP00000392718
MVAEVDSMPAASSVKKPFVLRSKMGKWCRHCFPCCRGSGKSNVGTSGDQDDSTMKTLRSKMGKWCCHCFPCCRGSGKSNVGTSGDHDDSAMKTLRSKMGKWCCHCFPCCRGSGKSNVGAWGDYDDSAFVEPRYHVRREDLDKLHRAAWWGKVARKDLIVMLRDTDVNKQDKQKRTALHLASANGNSGVVKLLLDRRCQLNVLDNKKRTALTKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLSNGVTAGNGDDGLIPQRKSRTPENQQFPDNESEEYHRICELVSDYKEKQMPKYSSENSNPEQDLKLTSEEESQRLKGSENGQPEKRSQEPEINKDGDRELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDFLHENSTLREEIAMLRLELDTMKHQSQLRKKKYLEDIESVKKKNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPILLTEAPLNPKANREKMTQIMFETFNTPAMYVAIQAMLSLYTSGRTTGIVMDSGDGVTHTVPIYDGNALPHATLRLDLAGRELTDYLMKILTERGYRFTTMAEREIVRDIKEKLCYVALDFEQEMAMAASSSSLEKSYELPDGQVITIGNEWFRCPEALFQPCFLGMESCGIHETTFNSIMKSDVDIRKDLYTNTVLSGGTTMYPGMAHRMQKEIAALAPSMLKIRIIAPPKRKYSVWVGGSILASLSTFQQMWISKQEYDESGPSIVHRKCF

SEQ ID NO: 65948 - protein, 508 aa, Homo sapiens
  Payload ID: 13145
  Gene Symbol: POTEI
  Gene Name: POTE ankyrin domain family, member I
  ENSP ID: ENSP00000483193
MVAEVDSMPAASSVKKPFVLRSKMGKWCRHCFPCCRGSGKSNVGTSGDQDDSTMKTLRSKMGKWCCHCFPCCRGSGKSNVGTSGDHDDSAMKTLRSKMGKWCCHCFPCCRGSGKSNVGAWGDYDDSAFVEPRYHVRREDLDKLHRAAWWGKVARKDLIVMLRDTDVNKQDKQKRTALHLASANGNSGVVKLLLDRRCQLNVLDNKKRTALTKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDRKVEEEMKKHGSTHVGFPENLTNGATAGNGDDGLIPPRKSRTPESQQFPDTENEEYHSDEQNDTQKQFCEEQNTGILHDEILIHEEKQIEVVENEF

SEQ ID NO: 65949 - protein, 376 aa, Homo sapiens
  Payload ID: 13145
  Gene Symbol: POTEI
  Gene Name: POTE ankyrin domain family, member I
  ENSP ID: ENSP00000486532
MVAEVDSMPAASSVKKPFVLRSKMGKWCRHCFPCCRGSGKSNVGTSGDQDDSTMKTLRSKMGKWCCHCFPCCRGSGKSNVGTSGDHDDSAMKTLRSKMGKWCCHCFPCCRGSGKSNVGAWGDYDDSAFVEPRYHVRREDLDKLHRAAWWGKVARKDLIVMLRDTDVNKQDKQKRTALHLASANGNSGVVKLLLDRRCQLNVLDNKKRTALTKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPG

SEQ ID NO: 65950 - protein, 1038 aa, Homo sapiens
  Payload ID: 13146
  Gene Symbol: POTEJ
  Gene Name: POTE ankyrin domain family, member J
  Uniprot ID: P0CG39
  ENSP ID: ENSP00000387176
MVAEVDSMPAASSVKKPFVLRSKMGKWCRHCFPCCRGSGKSNVGTSGDQDDSTMKTLRSKMGKWCCHCFPCCRGSGKSNVGAWGDYDDSAFVEPRYHVRREDLDKLHRAAWWGKVARKDLIVMLRDTDVNKQDKQKRTALHLASANGNSGVVKLLLDRRCQLNVLDNKKRTALTKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLSNGVTAGNGDDGLIPQRKSRTPENQQFPDNESEEYHRICELVSDYKEKQMPKYSSENSNPEQDLKLTSEEESQRLKGSENGQPEKRSQEPEINKDGDRELENFMAIEEMKKHGSTHVGFPENLTNGATAGNGDDGLIPPRKSRTPESQQFPDTENEEYHSDEQNDTQKQFCEEQNTGILHDEILIHEEKQIEVVEKMNSELSLSCKKERDFLHENSMLREEIAMLRLELDTMKHQSQLRKKKYLEDIESVKKKNDNLLKALQLNELTMDDDTAVLVIDNGSGMCKAGFAGDDAPRAVFPSIVGCPRQQGMMGGMHQKESYVGKEAQSKRGILTLKYPMEHGIITNWDDMEKIWHHTFYNELRVAPEEHPILLTEAPLNPKANREKMTQIMFETFNTPAMYVAIQAMLSLYTSGRTTGIVMDSGDGVTHTVPIYDGNALPHATLRLDLAGRELTDYLMKILTERGYRFTTMAEREIVRDIKEKLCYVALDFEQEMAMVASSSSLEKSYELPDGQVITISNEWFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCF

SEQ ID NO: 65951 - protein, 508 aa, Homo sapiens
  Payload ID: 13147
  Gene Symbol: POTEM
  Gene Name: POTE ankyrin domain family, member M
  Uniprot ID: A6NI47
  ENSP ID: ENSP00000448062
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTVLILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHSDEQNDTQKQLSEEQNTGILQDEILIHEEKQIEVAENEF

SEQ ID NO: 65952 - protein, 322 aa, Homo sapiens
  Payload ID: 13147
  Gene Symbol: POTEM
  Gene Name: POTE ankyrin domain family, member M
  ENSP ID: ENSP00000448581
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKIESHSVSQAGVQWCDHSSLQPRPPEAQMVLQPQPQFFFSFFLFIFIFIFIFF

SEQ ID NO: 65953 - protein, 486 aa, Homo sapiens
  Payload ID: 13147
  Gene Symbol: POTEM
  Gene Name: POTE ankyrin domain family, member M
  ENSP ID: ENSP00000483980
MVAEAGSMPAASSVKKPFGLRSKMGKWCRHCFPWCRGSGKSNVGTSGDHDDSAMKTLRSKMGKWCRHCFPWCRGSGKSNVGTSGDHDDSAMKTLRSKMGKWCCHCFPCCRGSGKSKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTVLILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLPNGATADNGDDGLIPPRKSRTPESQQFPDTENEQYHRDFSGHPNFPTTLPIKQ

SEQ ID NO: 65954 - protein, 291 aa, Homo sapiens
  Payload ID: 13148
  Gene Symbol: POU1F1
  Gene Name: POU class 1 homeobox 1
  Uniprot ID: P28069
  ENSP ID: ENSP00000263781
MSCQAFTSADTFIPLNSDASATLPLIMHHSAAECLPVSNHATNVMSTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 65955 - protein, 317 aa, Homo sapiens
  Payload ID: 13148
  Gene Symbol: POU1F1
  Gene Name: POU class 1 homeobox 1
  Uniprot ID: P28069
  ENSP ID: ENSP00000342931
MSCQAFTSADTFIPLNSDASATLPLIMHHSAAECLPVSNHATNVMSTVPSILSLIQTPKCLCTHFSVTTLGNTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 65956 - protein, 169 aa, Homo sapiens
  Payload ID: 13148
  Gene Symbol: POU1F1
  Gene Name: POU class 1 homeobox 1
  ENSP ID: ENSP00000452610
MSCQAFTSADTFIPLNSDASATLPLIMHHSAAECLPVSNHATNVMSTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLALLLKMLWRDTLENRINLLLKRS

SEQ ID NO: 65957 - protein, 216 aa, Homo sapiens
  Payload ID: 13148
  Gene Symbol: POU1F1
  Gene Name: POU class 1 homeobox 1
  ENSP ID: ENSP00000454072
MSCQAFTSADTFIPLNSDASATLPLIMHHSAAECLPVSNHATNVMSTATGLHYSVPSCHYGNQPSTYGVMAGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 65958 - protein, 256 aa, Homo sapiens
  Payload ID: 13149
  Gene Symbol: POU2AF1
  Gene Name: POU class 2 associating factor 1
  Uniprot ID: Q16633
  ENSP ID: ENSP00000376786
MLWQKPTAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 65959 - protein, 127 aa, Homo sapiens
  Payload ID: 13149
  Gene Symbol: POU2AF1
  Gene Name: POU class 2 associating factor 1
  ENSP ID: ENSP00000433527
MYFFIRDATAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQ

SEQ ID NO: 65960 - protein, 57 aa, Homo sapiens
  Payload ID: 13150
  Gene Symbol: POU2F1
  Gene Name: POU class 2 homeobox 1
  ENSP ID: ENSP00000271411
MADGGAASQDESSAAAAAAADWKSKKSFPAFLITKLLSVFNESVQRKNAVFLYLTQE

SEQ ID NO: 65961 - protein, 755 aa, Homo sapiens
  Payload ID: 13150
  Gene Symbol: POU2F1
  Gene Name: POU class 2 homeobox 1
  Uniprot ID: P14859
  ENSP ID: ENSP00000356836
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 65962 - protein, 766 aa, Homo sapiens
  Payload ID: 13150
  Gene Symbol: POU2F1
  Gene Name: POU class 2 homeobox 1
  Uniprot ID: P14859
  ENSP ID: ENSP00000356840
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 65963 - protein, 703 aa, Homo sapiens
  Payload ID: 13150
  Gene Symbol: POU2F1
  Gene Name: POU class 2 homeobox 1
  Uniprot ID: P14859
  ENSP ID: ENSP00000401217
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 65964 - protein, 60 aa, Homo sapiens
  Payload ID: 13150
  Gene Symbol: POU2F1
  Gene Name: POU class 2 homeobox 1
  ENSP ID: ENSP00000404571
MADGGAASQDESSAAAAAAADWKSKKSFPAFLITKLLSVFNESVQRKNAVFLYLVFFHHL

SEQ ID NO: 65965 - protein, 594 aa, Homo sapiens
  Payload ID: 13150
  Gene Symbol: POU2F1
  Gene Name: POU class 2 homeobox 1
  ENSP ID: ENSP00000414660
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQ

SEQ ID NO: 65966 - protein, 561 aa, Homo sapiens
  Payload ID: 13150
  Gene Symbol: POU2F1
  Gene Name: POU class 2 homeobox 1
  ENSP ID: ENSP00000415993
VQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQGLLHGLENFLTKN

SEQ ID NO: 65967 - protein, 743 aa, Homo sapiens
  Payload ID: 13150
  Gene Symbol: POU2F1
  Gene Name: POU class 2 homeobox 1
  Uniprot ID: P14859
  ENSP ID: ENSP00000441285
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 65968 - protein, 57 aa, Homo sapiens; identical to SEQ ID NO: 65960
  Payload ID: 13150
  Gene Symbol: POU2F1
  Gene Name: POU class 2 homeobox 1
  ENSP ID: ENSP00000453094

SEQ ID NO: 65969 - protein, 586 aa, Homo sapiens
  Payload ID: 13151
  Gene Symbol: POU2F2
  Gene Name: POU class 2 homeobox 2
  ENSP ID: ENSP00000339369
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGSTMVGLSSGLSPALMSNNPLATIQALASGGTLPLTSLDGSGNLVLGAAGAAPGSPGLVTSPLFLNHAGLPLLSTPPGVGLVSAAAAAVAASISSKSPGLSSSSSSSSSSSSSTCSETAAQTPGGPGGPEAGSKPE

SEQ ID NO: 65970 - protein, 463 aa, Homo sapiens
  Payload ID: 13151
  Gene Symbol: POU2F2
  Gene Name: POU class 2 homeobox 2
  Uniprot ID: P09086
  ENSP ID: ENSP00000373992
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 65971 - protein, 479 aa, Homo sapiens
  Payload ID: 13151
  Gene Symbol: POU2F2
  Gene Name: POU class 2 homeobox 2
  Uniprot ID: P09086
  ENSP ID: ENSP00000431603
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 65972 - protein, 117 aa, Homo sapiens
  Payload ID: 13151
  Gene Symbol: POU2F2
  Gene Name: POU class 2 homeobox 2
  ENSP ID: ENSP00000436100
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGLHEVRLIVVSPEETEA

SEQ ID NO: 65973 - protein, 467 aa, Homo sapiens
  Payload ID: 13151
  Gene Symbol: POU2F2
  Gene Name: POU class 2 homeobox 2
  Uniprot ID: P09086
  ENSP ID: ENSP00000436988
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTG

SEQ ID NO: 65974 - protein, 400 aa, Homo sapiens
  Payload ID: 13151
  Gene Symbol: POU2F2
  Gene Name: POU class 2 homeobox 2
  Uniprot ID: P09086
  ENSP ID: ENSP00000437224
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTAQTPALKAATRLSACQA

SEQ ID NO: 65975 - protein, 618 aa, Homo sapiens
  Payload ID: 13151
  Gene Symbol: POU2F2
  Gene Name: POU class 2 homeobox 2
  ENSP ID: ENSP00000452930
SMGAPEIRMSKPLEAEKQGLDSPSEHTDTERNGPDTNHQNPQNKTSPFSVSPTGPSTKVGILSGLHLTFWGPGPCLSPPQIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGSTMVGLSSGLSPALMSNNPLATIQGACCLMSHPSSPALSSGASSPAIAAPAMPSCPCSLHCLPLHTHLTFGEGVRGADGGQWDRWGDGGHSGQDAGRQRSPLARHALSPASLSPRQPWPLVEPCPLPALMAAGIWCWGQPVQPRGALAW

SEQ ID NO: 65976 - protein, 485 aa, Homo sapiens
  Payload ID: 13151
  Gene Symbol: POU2F2
  Gene Name: POU class 2 homeobox 2
  ENSP ID: ENSP00000453255
MVHSSMGAPEIRMSKPLEAEKQGLDSPSEHTDTERNGPDTNHQNPQNKTSPFSVSPTGPSTKVGILSGLHLTFWGPGPCLSPPQIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 65977 - protein, 198 aa, Homo sapiens
  Payload ID: 13151
  Gene Symbol: POU2F2
  Gene Name: POU class 2 homeobox 2
  ENSP ID: ENSP00000453995
  MOD_RES (1)..(1): Any amino acid
XGSDPRLVLQPAPEGETHQPLQCGPHAAQPREAGQLQPPYGHTPRGRGDLTVVPSFQQSEHNRSTMVGLSSGLSPALMSNNPLATIQALASGGTLPLTSLDGSGNLVLGAAGAAPGSPGLVTSPLFLNHAGLPLLSTPPGVGLVSAAAAAVAASISSKSPGLSSSSSSSSSSSSSTCSETAAQTPGGPGGPEAGSKPE

SEQ ID NO: 65978 - protein, 424 aa, Homo sapiens
  Payload ID: 13151
  Gene Symbol: POU2F2
  Gene Name: POU class 2 homeobox 2
  ENSP ID: ENSP00000454179
MVHSSMGAPEIRMSKPLEAEKQGLDSPSEHTDTERNGPDTNHQNPQNKTSPFSVSPTGPSTKDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 65979 - protein, 124 aa, Homo sapiens
  Payload ID: 13151
  Gene Symbol: POU2F2
  Gene Name: POU class 2 homeobox 2
  ENSP ID: ENSP00000471890
  MOD_RES (1)..(1): Any amino acid
XRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTGQGGQKMVRGDWEDVAQAGA

SEQ ID NO: 65980 - protein, 262 aa, Homo sapiens
  Payload ID: 13151
  Gene Symbol: POU2F2
  Gene Name: POU class 2 homeobox 2
  ENSP ID: ENSP00000475664
  MOD_RES (1)..(1): Any amino acid
XAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDA

SEQ ID NO: 65981 - protein, 220 aa, Homo sapiens
  Payload ID: 13151
  Gene Symbol: POU2F2
  Gene Name: POU class 2 homeobox 2
  ENSP ID: ENSP00000476062
  MOD_RES (1)..(1): Any amino acid
XAAASASSSTSSSSSSSASSSTSQPPASSGGGDLPPPQPASQPPGTPQLTLSQPIQLTAQDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLL

SEQ ID NO: 65982 - protein, 65 aa, Homo sapiens
  Payload ID: 13151
  Gene Symbol: POU2F2
  Gene Name: POU class 2 homeobox 2
  ENSP ID: ENSP00000476240
PEIRMSKPLEAEKQGLDSPSEHTDTERNGPDTNHQNPQNKTSPFSVSPTGPSTKVSTCQNSQGSG

SEQ ID NO: 65983 - protein, 112 aa, Homo sapiens
  Payload ID: 13151
  Gene Symbol: POU2F2
  Gene Name: POU class 2 homeobox 2
  ENSP ID: ENSP00000486228
MGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGLHEVRLIVVSPEETEA

SEQ ID NO: 65984 - protein, 438 aa, Homo sapiens
  Payload ID: 13152
  Gene Symbol: POU2F3
  Gene Name: POU class 2 homeobox 3
  Uniprot ID: Q9UKI9
  ENSP ID: ENSP00000260264
MESPRTAKGGRDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 65985 - protein, 126 aa, Homo sapiens
  Payload ID: 13152
  Gene Symbol: POU2F3
  Gene Name: POU class 2 homeobox 3
  ENSP ID: ENSP00000435738
MVNLESMHTDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQEDWRAT

SEQ ID NO: 65986 - protein, 436 aa, Homo sapiens
  Payload ID: 13152
  Gene Symbol: POU2F3
  Gene Name: POU class 2 homeobox 3
  Uniprot ID: Q9UKI9
  ENSP ID: ENSP00000441687
MVNLESMHTDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 65987 - protein, 160 aa, Homo sapiens
  Payload ID: 13152
  Gene Symbol: POU2F3
  Gene Name: POU class 2 homeobox 3
  ENSP ID: ENSP00000453150
GDVGLAMGKLYGNDFSQTTISRFEALNLSFKNMCKLKPLLEKWLNDAESSPSDPSVSTPSSYPSLSEVFGRKRKKRTSIETNIRLTLEKRFQDVSPSGSLGPLSVPPVHSTMPGTVTSSCSPGNNSRPSSPGSGLHASSPTASQNNSKAAVNSASSFNSS

SEQ ID NO: 65988 - protein, 451 aa, Homo sapiens
  Payload ID: 13153
  Gene Symbol: POU3F1
  Gene Name: POU class 3 homeobox 1
  Uniprot ID: Q03052
  ENSP ID: ENSP00000362103
MATTAQYLPRGPGGGAGGTGPLMHPDAAAAAAAAAAAERLHAGAAYREVQKLMHHEWLGAGAGHPVGLAHPQWLPTGGGGGGDWAGGPHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 65989 - protein, 443 aa, Homo sapiens
  Payload ID: 13154
  Gene Symbol: POU3F2
  Gene Name: POU class 3 homeobox 2
  Uniprot ID: P20265
  ENSP ID: ENSP00000329170
MATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 65990 - protein, 500 aa, Homo sapiens
  Payload ID: 13155
  Gene Symbol: POU3F3
  Gene Name: POU class 3 homeobox 3
  Uniprot ID: P20264
  ENSP ID: ENSP00000355001
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 65991 - protein, 361 aa, Homo sapiens
  Payload ID: 13156
  Gene Symbol: POU3F4
  Gene Name: POU class 3 homeobox 4
  Uniprot ID: P49335
  ENSP ID: ENSP00000362296
MATAASNPYSILSSTSLVHADSAGMQQGSPFRNPQKLLQSDYLQGVPSNGHPLGHHWVTSLSDGGPWSSTLATSPLDQQDVKPGREDLQLGAIIHHRSPHVAHHSPHTNHPNAWGASPAPNPSITSSGQPLNVYSQPGFTVSGMLEHGGLTPPPAAASAQSLHPVLREPPDHGELGSHHCQDHSDEETPTSDELEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGVLETHFLKCPKPAAQEISSLADSLQLEKEVVRVWFCNRRQKEKRMTPPGDQQPHEVYSHTVKTDTSCHDL

SEQ ID NO: 65992 - protein, 419 aa, Homo sapiens
  Payload ID: 13157
  Gene Symbol: POU4F1
  Gene Name: POU class 4 homeobox 1
  Uniprot ID: Q01851
  ENSP ID: ENSP00000366413
MMSMNSKQPHFAMHPTLPEHKYPSLHSSSEAIRRACLPTPPLQSNLFASLDETLLARAEALAAVDIAVSQGKSHPFKPDATYHTMNSVPCTSTSTVPLAHHHHHHHHHQALEPGDLLDHISSPSLALMAGAGGAGAAAGGGGAHDGPGGGGGPGGGGGPGGGPGGGGGGGPGGGGGGPGGGLLGGSAHPHPHMHSLGHLSHPAAAAAMNMPSGLPHPGLVAAAAHHGAAAAAAAAAAGQVAAASAAAAVVGAAGLASICDSDTDPRELEAFAERFKQRRIKLGVTQADVGSALANLKIPGVGSLSQSTICRFESLTLSHNNMIALKPILQAWLEEAEGAQREKMNKPELFNGGEKKRKRTSIAAPEKRSLEAYFAVQPRPSSEKIAAIAEKLDLKKNVVRVWFCNQRQKQKRMKFSATY

SEQ ID NO: 65993 - protein, 409 aa, Homo sapiens
  Payload ID: 13158
  Gene Symbol: POU4F2
  Gene Name: POU class 4 homeobox 2
  Uniprot ID: Q12837
  ENSP ID: ENSP00000281321
MMMMSLNSKQAFSMPHGGSLHVEPKYSALHSTSPGSSAPIAPSASSPSSSSNAGGGGGGGGGGGGGGGRSSSSSSSGSSGGGGSEAMRRACLPTPPSNIFGGLDESLLARAEALAAVDIVSQSKSHHHHPPHHSPFKPDATYHTMNTIPCTSAASSSSVPISHPSALAGTHHHHHHHHHHHHQPHQALEGELLEHLSPGLALGAMAGPDGAVVSTPAHAPHMATMNPMHQAALSMAHAHGLPSHMGCMSDVDADPRDLEAFAERFKQRRIKLGVTQADVGSALANLKIPGVGSLSQSTICRFESLTLSHNNMIALKPILQAWLEEAEKSHREKLTKPELFNGAEKKRKRTSIAAPEKRSLEAYFAIQPRPSSEKIAAIAEKLDLKKNVVRVWFCNQRQKQKRMKYSAGI

SEQ ID NO: 65994 - protein, 338 aa, Homo sapiens
  Payload ID: 13159
  Gene Symbol: POU4F3
  Gene Name: POU class 4 homeobox 3
  Uniprot ID: Q15319
  ENSP ID: ENSP00000230732
MMAMNSKQPFGMHPVLQEPKFSSLHSGSEAMRRVCLPAPQLQGNIFGSFDESLLARAEALAAVDIVSHGKNHPFKPDATYHTMSSVPCTSTSSTVPISHPAALTSHPHHAVHQGLEGDLLEHISPTLSVSGLGAPEHSVMPAQIHPHHLGAMGHLHQAMGMSHPHTVAPHSAMPACLSDVESDPRELEAFAERFKQRRIKLGVTQADVGAALANLKIPGVGSLSQSTICRFESLTLSHNNMIALKPVLQAWLEEAEAAYREKNSKPELFNGSERKRKRTSIAAPEKRSLEAYFAIQPRPSSEKIAAIAEKLDLKKNVVRVWFCNQRQKQKRMKYSAVH

SEQ ID NO: 65995 - protein, 360 aa, Homo sapiens
  Payload ID: 13160
  Gene Symbol: POU5F1
  Gene Name: POU class 5 homeobox 1
  Uniprot ID: Q01860
  ENSP ID: ENSP00000259915
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 65996 - protein, 265 aa, Homo sapiens
  Payload ID: 13160
  Gene Symbol: POU5F1
  Gene Name: POU class 5 homeobox 1
  Uniprot ID: Q01860
  ENSP ID: ENSP00000365419
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 65997 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000373016

SEQ ID NO: 65998 - protein, 265 aa, Homo sapiens; identical to SEQ ID NO: 65996
  Payload ID: 13160
  Gene Symbol: POU5F1
  Gene Name: POU class 5 homeobox 1
  Uniprot ID: Q01860
  ENSP ID: ENSP00000387619

SEQ ID NO: 65999 - protein, 265 aa, Homo sapiens; identical to SEQ ID NO: 65996
  Payload ID: 13160
  Gene Symbol: POU5F1
  Gene Name: POU class 5 homeobox 1
  Uniprot ID: Q01860
  ENSP ID: ENSP00000387646

SEQ ID NO: 66000 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000388842

SEQ ID NO: 66001 - protein, 164 aa, Homo sapiens
  Payload ID: 13160
  Gene Symbol: POU5F1
  Gene Name: POU class 5 homeobox 1
  ENSP ID: ENSP00000389359
MCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 66002 - protein, 265 aa, Homo sapiens; identical to SEQ ID NO: 65996
  Payload ID: 13160
  Gene Symbol: POU5F1
  Gene Name: POU class 5 homeobox 1
  Uniprot ID: Q01860
  ENSP ID: ENSP00000391507

SEQ ID NO: 66003 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000391681

SEQ ID NO: 66004 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000392877

SEQ ID NO: 66005 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000400047

SEQ ID NO: 66006 - protein, 360 aa, Homo sapiens; identical to SEQ ID NO: 65995
  Payload ID: 13160
  Gene Symbol: POU5F1
  Gene Name: POU class 5 homeobox 1
  Uniprot ID: Q01860
  ENSP ID: ENSP00000405041

SEQ ID NO: 66007 - protein, 265 aa, Homo sapiens; identical to SEQ ID NO: 65996
  Payload ID: 13160
  Gene Symbol: POU5F1
  Gene Name: POU class 5 homeobox 1
  Uniprot ID: Q01860
  ENSP ID: ENSP00000412665

SEQ ID NO: 66008 - protein, 265 aa, Homo sapiens; identical to SEQ ID NO: 65996
  Payload ID: 13160
  Gene Symbol: POU5F1
  Gene Name: POU class 5 homeobox 1
  Uniprot ID: Q01860
  ENSP ID: ENSP00000413622

SEQ ID NO: 66009 - protein, 164 aa, Homo sapiens; identical to SEQ ID NO: 66001
  Payload ID: 13160
  Gene Symbol: POU5F1
  Gene Name: POU class 5 homeobox 1
  ENSP ID: ENSP00000425083

SEQ ID NO: 66010 - protein, 164 aa, Homo sapiens; identical to SEQ ID NO: 66001
  Payload ID: 13160
  Gene Symbol: POU5F1
  Gene Name: POU class 5 homeobox 1
  ENSP ID: ENSP00000425479

SEQ ID NO: 66011 - protein, 186 aa, Homo sapiens
  Payload ID: 13160
  Gene Symbol: POU5F1
  Gene Name: POU class 5 homeobox 1
  ENSP ID: ENSP00000446561
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVAHPGGSIWEGIQPNDHLPL

SEQ ID NO: 66012 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000446815

SEQ ID NO: 66013 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000447156

SEQ ID NO: 66014 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000447969

SEQ ID NO: 66015 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000448254

SEQ ID NO: 66016 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000449442

SEQ ID NO: 66017 - protein, 164 aa, Homo sapiens; identical to SEQ ID NO: 66001
  Payload ID: 13160
  Gene Symbol: POU5F1
  Gene Name: POU class 5 homeobox 1
  ENSP ID: ENSP00000475512

SEQ ID NO: 66018 - protein, 190 aa, Homo sapiens
  Payload ID: 13160
  Gene Symbol: POU5F1
  Gene Name: POU class 5 homeobox 1
  ENSP ID: ENSP00000475880
LGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 66019 - protein, 186 aa, Homo sapiens; identical to SEQ ID NO: 66011
  Payload ID: 13160
  Gene Symbol: POU5F1
  Gene Name: POU class 5 homeobox 1
  ENSP ID: ENSP00000481679

SEQ ID NO: 66020 - protein, 190 aa, Homo sapiens; identical to SEQ ID NO: 66018
  Payload ID: 13160
  Gene Symbol: POU5F1
  Gene Name: POU class 5 homeobox 1
  ENSP ID: ENSP00000484778

SEQ ID NO: 66021 - protein, 359 aa, Homo sapiens
  Payload ID: 13161
  Gene Symbol: POU5F1B
  Gene Name: POU class 5 homeobox 1B
  Uniprot ID: Q06416
  ENSP ID: ENSP00000419298
MAGHLASDFAFSPPPGGGGDGPWGAEPGWVDPLTWLSFQGPPGGPGIGPGVGPGSEVWGIPPCPPPYELCGGMAYCGPQVGVGLVPQGGLETSQPESEAGVGVESNSNGASPEPCTVPPGAVKLEKEKLEQNPEKSQDIKALQKELEQFAKLLKQKRITLGYTQADVGLILGVLFGKVFSQKTICRFEALQLSFKNMCKLRPLLQKWVEEADNNENLQEICKAETLMQARKRKRTSIENRVRGNLENLFLQCPKPTLQISHIAQQLGLEKDVVRVWFCNRRQKGKRSSSDYAQREDFEAAGSPFSGGPVSFPPAPGPHFGTPGYGSPHFTALYSSVPFPEGEVFPPVSVITLGSPMHSN

SEQ ID NO: 66022 - protein, 301 aa, Homo sapiens
  Payload ID: 13162
  Gene Symbol: POU6F1
  Gene Name: POU class 6 homeobox 1
  Uniprot ID: Q14863
  ENSP ID: ENSP00000330190
MPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 66023 - protein, 301 aa, Homo sapiens; identical to SEQ ID NO: 66022
  Payload ID: 13162
  Gene Symbol: POU6F1
  Gene Name: POU class 6 homeobox 1
  Uniprot ID: Q14863
  ENSP ID: ENSP00000373895

SEQ ID NO: 66024 - protein, 29 aa, Homo sapiens
  Payload ID: 13162
  Gene Symbol: POU6F1
  Gene Name: POU class 6 homeobox 1
  ENSP ID: ENSP00000448266
MPGISSQILTNAQGQVIGTLPWVVNSASV

SEQ ID NO: 66025 - protein, 301 aa, Homo sapiens; identical to SEQ ID NO: 66022
  Payload ID: 13162
  Gene Symbol: POU6F1
  Gene Name: POU class 6 homeobox 1
  Uniprot ID: Q14863
  ENSP ID: ENSP00000448389

SEQ ID NO: 66026 - protein, 691 aa, Homo sapiens
  Payload ID: 13163
  Gene Symbol: POU6F2
  Gene Name: POU class 6 homeobox 2
  Uniprot ID: P78424
  ENSP ID: ENSP00000384004
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRHTILRSHFFLPQEAQENTIASSLTAKLNPGLLYPARFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 66027 - protein, 142 aa, Homo sapiens
  Payload ID: 13163
  Gene Symbol: POU6F2
  Gene Name: POU class 6 homeobox 2
  ENSP ID: ENSP00000404868
ASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQILKRQRVRWMGLIWRRSENLPKLLKSGACPLA

SEQ ID NO: 66028 - protein, 144 aa, Homo sapiens
  Payload ID: 13163
  Gene Symbol: POU6F2
  Gene Name: POU class 6 homeobox 2
  ENSP ID: ENSP00000409684
METMAWTDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPT

SEQ ID NO: 66029 - protein, 655 aa, Homo sapiens
  Payload ID: 13163
  Gene Symbol: POU6F2
  Gene Name: POU class 6 homeobox 2
  Uniprot ID: P78424
  ENSP ID: ENSP00000430514
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 66030 - protein, 636 aa, Homo sapiens
  Payload ID: 13163
  Gene Symbol: POU6F2
  Gene Name: POU class 6 homeobox 2
  ENSP ID: ENSP00000452633
MIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRHTILRSHFFLPQEAQENTIASSLTAKLNPGLLYPARFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 66031 - protein, 412 aa, Homo sapiens
  Payload ID: 13163
  Gene Symbol: POU6F2
  Gene Name: POU class 6 homeobox 2
  ENSP ID: ENSP00000452911
MIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVS

SEQ ID NO: 66032 - protein, 403 aa, Homo sapiens
  Payload ID: 13163
  Gene Symbol: POU6F2
  Gene Name: POU class 6 homeobox 2
  ENSP ID: ENSP00000453020
MIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQ

SEQ ID NO: 66033 - protein, 328 aa, Homo sapiens
  Payload ID: 13164
  Gene Symbol: POU5F2
  Gene Name: POU domain class 5, transcription factor 2
  Uniprot ID: Q8N7G0
  ENSP ID: ENSP00000464890
MAGHRPSNHFCPLPGSGGGGPRGPMPLRVDTLTWLSTQAAPGRVMVWPAVRPGICPGPDVWRIPLGPLPHEFRGWIAPCRPRLGASEAGDWLRRPSEGALPGPYIALRSIPKLPPPEDISGILKELQQLAKELRQKRLSLGYSQADVGIAVGALFGKVLSQTTICRFEAQQLSVANMWKLRPLLKKWLKEVEAENLLGLCKMEMILQQSGKWRRASRERRIGNSLEKFFQRCPKPTPQQISHIAGCLQLQKDVVRVWFYNRSKMGSRPTNDASPREIVGTAGPPCPGAPVCFHLGLGLPVDIPHYTRLYSAGVAHSSAPATTLGLLRF

SEQ ID NO: 66034 - protein, 537 aa, Homo sapiens
  Payload ID: 13165
  Gene Symbol: PATZ1
  Gene Name: POZ (BTB) and AT hook containing zinc finger 1
  Uniprot ID: Q9HBE1
  ENSP ID: ENSP00000215919
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 66035 - protein, 687 aa, Homo sapiens
  Payload ID: 13165
  Gene Symbol: PATZ1
  Gene Name: POZ (BTB) and AT hook containing zinc finger 1
  Uniprot ID: Q9HBE1
  ENSP ID: ENSP00000266269
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 66036 - protein, 641 aa, Homo sapiens
  Payload ID: 13165
  Gene Symbol: PATZ1
  Gene Name: POZ (BTB) and AT hook containing zinc finger 1
  Uniprot ID: Q9HBE1
  ENSP ID: ENSP00000337520
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 66037 - protein, 537 aa, Homo sapiens
  Payload ID: 13165
  Gene Symbol: PATZ1
  Gene Name: POZ (BTB) and AT hook containing zinc finger 1
  Uniprot ID: Q9HBE1
  ENSP ID: ENSP00000384173
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 66038 - protein, 794 aa, Homo sapiens
  Payload ID: 13166
  Gene Symbol: PPAN-P2RY11
  Gene Name: PPAN-P2RY11 readthrough
  ENSP ID: ENSP00000377385
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 66039 - protein, 520 aa, Homo sapiens
  Payload ID: 13166
  Gene Symbol: PPAN-P2RY11
  Gene Name: PPAN-P2RY11 readthrough
  ENSP ID: ENSP00000411918
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQVPSPALPTSWQLPTTNSVGSRGTSCGPYWWLSSWWPWPAMAWPCTASASGSSAHGTPPWSSLSSWQSATCSAP

SEQ ID NO: 66040 - protein, 676 aa, Homo sapiens
  Payload ID: 13167
  Gene Symbol: PERM1
  Gene Name: PPARGC1 and ESRR induced regulator, muscle 1
  Uniprot ID: Q5SV97
  ENSP ID: ENSP00000343864
MEPRGGGSSQFSSCPGPASSGDQMQRLLQGPAPRPPGEPPGSPKSPGHSTGSQRPPDSPGAPPRSPSRKKRRAVGAKGGGHTGASASAQTGSPLLPAASPETAKLMAKAGQEELGPGPAGAPEPGPRSPVQEDRPGPGLGLSTPVPVTEQGTDQIRTPRRAKLHTVSTTVWEALPDVSRAKSDMAVSTPASEPQPDRDMAVSTPASEPQSDRDMAVSTPASEPQPDTDMAVSTPASEPQPDRDMAVSIPASKPQSDTAVSTPASEPQSSVALSTPISKPQLDTDVAVSTPASKHGLDVALPTAGPVAKLEVASSPPVSEAVPRMTESSGLVSTPVPRADAAGLAWPPTRRAGPDVVEMEAVVSEPSAGAPGCCSGAPALGLTQVPRKKKVRFSVAGPSPNKPGSGQASARPSAPQTATGAHGGPGAWEAVAVGPRPHQPRILKHLPRPPPSAVTRVGPGSSFAVTLPEAYEFFFCDTIEENEEAEAAAAGQDPAGVQWPDMCEFFFPDVGAQRSRRRGSPEPLPRADPVPAPIPGDPVPISIPEVYEHFFFGEDRLEGVLGPAVPLPLQALEPPRSASEGAGPGTPLKPAVVERLHLALRRAGELRGPVPSFAFSQNDMCLVFVAFATWAVRTSDPHTPDAWKTALLANVGTISAIRYFRRQVGQGRRSHSPSPSS

SEQ ID NO: 66041 - protein, 790 aa, Homo sapiens
  Payload ID: 13167
  Gene Symbol: PERM1
  Gene Name: PPARGC1 and ESRR induced regulator, muscle 1
  Uniprot ID: Q5SV97
  ENSP ID: ENSP00000414022
MENFQYSVQLSDQDWAEFSATADECGLLQAGLASGDELLSSDIDQGDSSGSSPPRAPPLPTGQLAAGGRSRRGCEEEDVATQQPVSRSQGEPVLALGTGQQTPSTSARAEAPPSLGPGASPPSQFSSCPGPASSGDQMQRLLQGPAPRPPGEPPGSPKSPGHSTGSQRPPDSPGAPPRSPSRKKRRAVGAKGGGHTGASASAQTGSPLLPAASPETAKLMAKAGQEELGPGPAGAPEPGPRSPVQEDRPGPGLGLSTPVPVTEQGTDQIRTPRRAKLHTVSTTVWEALPDVSRAKSDMAVSTPASEPQPDRDMAVSTPASEPQSDRDMAVSTPASEPQPDTDMAVSTPASEPQPDRDMAVSIPASKPQSDTAVSTPASEPQSSVALSTPISKPQLDTDVAVSTPASKHGLDVALPTAGPVAKLEVASSPPVSEAVPRMTESSGLVSTPVPRADAAGLAWPPTRRAGPDVVEMEAVVSEPSAGAPGCCSGAPALGLTQVPRKKKVRFSVAGPSPNKPGSGQASARPSAPQTATGAHGGPGAWEAVAVGPRPHQPRILKHLPRPPPSAVTRVGPGSSFAVTLPEAYEFFFCDTIEENEEAEAAAAGQDPAGVQWPDMCEFFFPDVGAQRSRRRGSPEPLPRADPVPAPIPGDPVPISIPEVYEHFFFGEDRLEGVLGPAVPLPLQALEPPRSASEGAGPGTPLKPAVVERLHLALRRAGELRGPVPSFAFSQNDMCLVFVAFATWAVRTSDPHTPDAWKTALLANVGTISAIRYFRRQVGQGRRSHSPSPSS

SEQ ID NO: 66042 - protein, 171 aa, Homo sapiens
  Payload ID: 13168
  Gene Symbol: PPP5D1
  Gene Name: PPP5 tetratricopeptide repeat domain containing 1
  Uniprot ID: E7EU14
  ENSP ID: ENSP00000392262
MAEMRAWRPLVRPSLQCVKLGRATARWWWVVKVKPHDKDAKMKYQECNKIVKQKAFERAIAGDEHKRSVVDSLDIESMTIEGEYSGPKLEDDKVTITFMKGLMQWYKDQKKLHQKCAYQGLALSPRLKCSGTITAHCSLNLLGPRDPPTSASQVAVTEGMHHHTWLIFLFL

SEQ ID NO: 66043 - protein, 125 aa, Homo sapiens
  Payload ID: 13168
  Gene Symbol: PPP5D1
  Gene Name: PPP5 tetratricopeptide repeat domain containing 1
  ENSP ID: ENSP00000471730
  MOD_RES (1)..(1): Any amino acid
XSLQCVKLGRATARWWWVVKVKPHDKDAKMKYQECNKIVKQKAFERAIAGDEHKRSVVDSLDIESMTIEGEYSGPKLEDDKVTITFMKGLMQWYKDQKKLHQKCAYQDFRQKSGIITSQDCVQTT

SEQ ID NO: 66044 - protein, 131 aa, Homo sapiens
  Payload ID: 13168
  Gene Symbol: PPP5D1
  Gene Name: PPP5 tetratricopeptide repeat domain containing 1
  ENSP ID: ENSP00000481586
  MOD_RES (1)..(1): Any amino acid
XSLQCVKLGRATARWWWVVKVKPHDKDAKMKYQECNKIVKQKAFERAIAGDEHKRSVVDSLDIESMTIEGEYSGPKLEDDKVTITFMKGLMQWYKDQKKLHQKCAYQVMHLSGTGHPGTLGWHHSTARRGH

SEQ ID NO: 66045 - protein, 129 aa, Homo sapiens
  Payload ID: 13169
  Gene Symbol: PPT2-EGFL8
  Gene Name: PPT2-EGFL8 readthrough (NMD candidate)
  ENSP ID: ENSP00000455023
  MOD_RES (1)..(1): Any amino acid
XPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPGGNGEREEACRVQRQSESWGPGLSCALS

SEQ ID NO: 66046 - protein, 301 aa, Homo sapiens
  Payload ID: 13169
  Gene Symbol: PPT2-EGFL8
  Gene Name: PPT2-EGFL8 readthrough (NMD candidate)
  ENSP ID: ENSP00000455087
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 66047 - protein, 301 aa, Homo sapiens; identical to SEQ ID NO: 66046
  Payload ID: 13169
  Gene Symbol: PPT2-EGFL8
  Gene Name: PPT2-EGFL8 readthrough (NMD candidate)
  ENSP ID: ENSP00000457534

SEQ ID NO: 66048 - protein, 97 aa, Homo sapiens; identical to SEQ ID NO: 61027
  Payload ID: 13169
  Gene Symbol: PPT2-EGFL8
  Gene Name: PPT2-EGFL8 readthrough (NMD candidate)
  ENSP ID: ENSP00000461909

SEQ ID NO: 66049 - protein, 97 aa, Homo sapiens; identical to SEQ ID NO: 61027
  Payload ID: 13169
  Gene Symbol: PPT2-EGFL8
  Gene Name: PPT2-EGFL8 readthrough (NMD candidate)
  ENSP ID: ENSP00000463570

SEQ ID NO: 66050 - protein, 74 aa, Homo sapiens
  Payload ID: 13170
  Gene Symbol: PQLC1
  Gene Name: PQ loop repeat containing 1
  ENSP ID: ENSP00000315627
  MOD_RES (1)..(1): Any amino acid
XRDIRRTQNADGFSTYVCLVLLVANILRILFCLSVRADWKVSAALPMKRAWWRGGEKESRQLVSRTLLLTLVTE

SEQ ID NO: 66051 - protein, 253 aa, Homo sapiens
  Payload ID: 13170
  Gene Symbol: PQLC1
  Gene Name: PQ loop repeat containing 1
  Uniprot ID: Q8N2U9
  ENSP ID: ENSP00000350188
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 66052 - protein, 271 aa, Homo sapiens
  Payload ID: 13170
  Gene Symbol: PQLC1
  Gene Name: PQ loop repeat containing 1
  Uniprot ID: Q8N2U9
  ENSP ID: ENSP00000380880
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 66053 - protein, 132 aa, Homo sapiens
  Payload ID: 13170
  Gene Symbol: PQLC1
  Gene Name: PQ loop repeat containing 1
  Uniprot ID: Q8N2U9
  ENSP ID: ENSP00000465546
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTASRWCSCGPVVTPSRRPTSC

SEQ ID NO: 66054 - protein, 67 aa, Homo sapiens
  Payload ID: 13170
  Gene Symbol: PQLC1
  Gene Name: PQ loop repeat containing 1
  ENSP ID: ENSP00000466423
MEAEGLDWLLVPLHQLVSWGAAAAMVFGGVVPYVPQYRDIRRTQNADGFSTYVCLVLLVANILRILF

SEQ ID NO: 66055 - protein, 136 aa, Homo sapiens
  Payload ID: 13170
  Gene Symbol: PQLC1
  Gene Name: PQ loop repeat containing 1
  ENSP ID: ENSP00000466491
AAAAMVFGGVVPYVPQYRDIRRTQNADGFSTYVCLVLLVANILRILFCPYYHFAKPAFSRSHSVECQHSGFGRFGRRFESPLLWQSAIMILTMLLMLKLCTEVRVANELNARRRSFTDFDPHHFWQWSSFSDYVQC

SEQ ID NO: 66056 - protein, 81 aa, Homo sapiens
  Payload ID: 13170
  Gene Symbol: PQLC1
  Gene Name: PQ loop repeat containing 1
  ENSP ID: ENSP00000467705
MEAEGLDWLLVPLHQLVSWGAAAAMVFGGVVPYVPQYRDIRRTQNADGFSTYVCLVLLVANILRILFWLECSGTISAHCSL

SEQ ID NO: 66057 - protein, 67 aa, Homo sapiens; identical to SEQ ID NO: 66054
  Payload ID: 13170
  Gene Symbol: PQLC1
  Gene Name: PQ loop repeat containing 1
  ENSP ID: ENSP00000468210

SEQ ID NO: 66058 - protein, 132 aa, Homo sapiens
  Payload ID: 13170
  Gene Symbol: PQLC1
  Gene Name: PQ loop repeat containing 1
  ENSP ID: ENSP00000468427
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLVL

SEQ ID NO: 66059 - protein, 291 aa, Homo sapiens
  Payload ID: 13171
  Gene Symbol: PQLC2
  Gene Name: PQ loop repeat containing 2
  Uniprot ID: Q6ZP29
  ENSP ID: ENSP00000364295
MVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 66060 - protein, 291 aa, Homo sapiens; identical to SEQ ID NO: 66059
  Payload ID: 13171
  Gene Symbol: PQLC2
  Gene Name: PQ loop repeat containing 2
  Uniprot ID: Q6ZP29
  ENSP ID: ENSP00000364297

SEQ ID NO: 66061 - protein, 226 aa, Homo sapiens
  Payload ID: 13171
  Gene Symbol: PQLC2
  Gene Name: PQ loop repeat containing 2
  Uniprot ID: Q6ZP29
  ENSP ID: ENSP00000383395
MDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 66062 - protein, 127 aa, Homo sapiens
  Payload ID: 13171
  Gene Symbol: PQLC2
  Gene Name: PQ loop repeat containing 2
  ENSP ID: ENSP00000404701
PLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNSCTPPVCQAPSWTLEP

SEQ ID NO: 66063 - protein, 35 aa, Homo sapiens
  Payload ID: 13171
  Gene Symbol: PQLC2
  Gene Name: PQ loop repeat containing 2
  ENSP ID: ENSP00000431417
MDQALSLWFLLGWIGGDSCNLIGSFLADQLPLQTW

SEQ ID NO: 66064 - protein, 100 aa, Homo sapiens
  Payload ID: 13171
  Gene Symbol: PQLC2
  Gene Name: PQ loop repeat containing 2
  ENSP ID: ENSP00000433620
MVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTW

SEQ ID NO: 66065 - protein, 118 aa, Homo sapiens
  Payload ID: 13172
  Gene Symbol: PQLC2L
  Gene Name: PQ loop repeat containing 2-like
  Uniprot ID: A1A4F0
  ENSP ID: ENSP00000312323
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKISEEDLRKELHFCCLHWP

SEQ ID NO: 66066 - protein, 133 aa, Homo sapiens
  Payload ID: 13172
  Gene Symbol: PQLC2L
  Gene Name: PQ loop repeat containing 2-like
  Uniprot ID: A1A4F0
  ENSP ID: ENSP00000387918
MKVVGNYRVNTANSSTDTSGEHLTCLRSQLFVAYRNGRVDEAVSLGFLDCWIGGDLTNFKGCYLTNQLPIQDIPTSVIQRLHHQRESQIVTLGSPLPCIYPIFFQISEISMPGYYSCLCHTTINTSKRRFILT

SEQ ID NO: 66067 - protein, 135 aa, Homo sapiens
  Payload ID: 13172
  Gene Symbol: PQLC2L
  Gene Name: PQ loop repeat containing 2-like
  Uniprot ID: A1A4F0
  ENSP ID: ENSP00000413228
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKMIFQPQLFKDSITREKVRLSLWGVLCPVYIPYSFR

SEQ ID NO: 66068 - protein, 56 aa, Homo sapiens
  Payload ID: 13172
  Gene Symbol: PQLC2L
  Gene Name: PQ loop repeat containing 2-like
  ENSP ID: ENSP00000417372
MKVVGNYRVNTANSSTDTSGEHLTCLRRLMKKSLHGICCSHGQGEAKSLVKTHQGL

SEQ ID NO: 66069 - protein, 33 aa, Homo sapiens
  Payload ID: 13172
  Gene Symbol: PQLC2L
  Gene Name: PQ loop repeat containing 2-like
  ENSP ID: ENSP00000420049
MKVVGNYRVNTANSSTDTSGEHLTCLRRFENNL

SEQ ID NO: 66070 - protein, 72 aa, Homo sapiens
  Payload ID: 13172
  Gene Symbol: PQLC2L
  Gene Name: PQ loop repeat containing 2-like
  Uniprot ID: A1A4F0
  ENSP ID: ENSP00000420317
MKVVGNYRVNTANSSTDTSGEHLTCLRSQLFVAYRNGRVDEAVSLGFLDCWIGGDLTNFKGCYLTNQLPIQF

SEQ ID NO: 66071 - protein, 202 aa, Homo sapiens
  Payload ID: 13173
  Gene Symbol: PQLC3
  Gene Name: PQ loop repeat containing 3
  Uniprot ID: Q8N755
  ENSP ID: ENSP00000295083
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCATRIITTLMTTNDFTILLRFVIMLALNIWVTVTVLRYRKTAIKAE

SEQ ID NO: 66072 - protein, 120 aa, Homo sapiens
  Payload ID: 13173
  Gene Symbol: PQLC3
  Gene Name: PQ loop repeat containing 3
  ENSP ID: ENSP00000384129
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMQE

SEQ ID NO: 66073 - protein, 188 aa, Homo sapiens
  Payload ID: 13173
  Gene Symbol: PQLC3
  Gene Name: PQ loop repeat containing 3
  Uniprot ID: Q8N755
  ENSP ID: ENSP00000406148
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCAILLRFVIMLALNIWVTVTVLRYRKTAIKAE

SEQ ID NO: 66074 - protein, 169 aa, Homo sapiens
  Payload ID: 13173
  Gene Symbol: PQLC3
  Gene Name: PQ loop repeat containing 3
  ENSP ID: ENSP00000406587
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCARSRSLSQAGVQ

SEQ ID NO: 66075 - protein, 181 aa, Homo sapiens
  Payload ID: 13173
  Gene Symbol: PQLC3
  Gene Name: PQ loop repeat containing 3
  ENSP ID: ENSP00000410430
MRVVRGLSEPGRARRRGARARGAMEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCA

SEQ ID NO: 66076 - protein, 82 aa, Homo sapiens
  Payload ID: 13173
  Gene Symbol: PQLC3
  Gene Name: PQ loop repeat containing 3
  ENSP ID: ENSP00000416170
  MOD_RES (1)..(1): Any amino acid
XLPQISAVLAARSARGLSLPSLLLELAGFLVFLRYQCYYGYPPLTYLEYPILIAQDVILLLCIFHFNGNVKQATPYIAVYPF

SEQ ID NO: 66077 - protein, 691 aa, Homo sapiens
  Payload ID: 13174
  Gene Symbol: PRDM1
  Gene Name: PR domain containing 1, with ZNF domain
  Uniprot ID: O75626
  ENSP ID: ENSP00000358085
MEKIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 66078 - protein, 789 aa, Homo sapiens
  Payload ID: 13174
  Gene Symbol: PRDM1
  Gene Name: PR domain containing 1, with ZNF domain
  Uniprot ID: O75626
  ENSP ID: ENSP00000358087
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 66079 - protein, 825 aa, Homo sapiens
  Payload ID: 13174
  Gene Symbol: PRDM1
  Gene Name: PR domain containing 1, with ZNF domain
  Uniprot ID: O75626
  ENSP ID: ENSP00000358092
MLDICLEKRVGTTLAAPKCNSSTVRFQGLAEGTKGTMKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 66080 - protein, 63 aa, Homo sapiens
  Payload ID: 13174
  Gene Symbol: PRDM1
  Gene Name: PR domain containing 1, with ZNF domain
  ENSP ID: ENSP00000395566
MKMDMEDADMTLWTEAEFEEKCTYIVNDHPWDSGADGGTSVQAEASLPRNLLFKYATNSEEVI

SEQ ID NO: 66081 - protein, 171 aa, Homo sapiens
  Payload ID: 13174
  Gene Symbol: PRDM1
  Gene Name: PR domain containing 1, with ZNF domain
  ENSP ID: ENSP00000399772
MAGEVHLCPTQCFHKKIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMP

SEQ ID NO: 66082 - protein, 788 aa, Homo sapiens
  Payload ID: 13174
  Gene Symbol: PRDM1
  Gene Name: PR domain containing 1, with ZNF domain
  ENSP ID: ENSP00000478294
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPTPCSTPLLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 66083 - protein, 1023 aa, Homo sapiens
  Payload ID: 13175
  Gene Symbol: PRDM10
  Gene Name: PR domain containing 10
  Uniprot ID: Q9NQV6
  ENSP ID: ENSP00000302669
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66084 - protein, 1160 aa, Homo sapiens
  Payload ID: 13175
  Gene Symbol: PRDM10
  Gene Name: PR domain containing 10
  Uniprot ID: Q9NQV6
  ENSP ID: ENSP00000351686
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66085 - protein, 1156 aa, Homo sapiens
  Payload ID: 13175
  Gene Symbol: PRDM10
  Gene Name: PR domain containing 10
  Uniprot ID: Q9NQV6
  ENSP ID: ENSP00000354118
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66086 - protein, 1061 aa, Homo sapiens
  Payload ID: 13175
  Gene Symbol: PRDM10
  Gene Name: PR domain containing 10
  Uniprot ID: Q9NQV6
  ENSP ID: ENSP00000398431
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66087 - protein, 1117 aa, Homo sapiens
  Payload ID: 13175
  Gene Symbol: PRDM10
  Gene Name: PR domain containing 10
  ENSP ID: ENSP00000431262
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66088 - protein, 139 aa, Homo sapiens
  Payload ID: 13175
  Gene Symbol: PRDM10
  Gene Name: PR domain containing 10
  ENSP ID: ENSP00000432093
MDSKDESSHVWPTSAEHEQNAAQVHFVPDTGTVAQIVYTDDQVRPPQQVVYTADGASYTSVDGPEHTLVYIHPVEAAQASLPVHNQVLPSIESVDGSDPLATLQTPLGRLEAKEEEDEDEDEDTEEDEEEDGEDTDLDD

SEQ ID NO: 66089 - protein, 1074 aa, Homo sapiens
  Payload ID: 13175
  Gene Symbol: PRDM10
  Gene Name: PR domain containing 10
  Uniprot ID: Q9NQV6
  ENSP ID: ENSP00000432237
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 66090 - protein, 865 aa, Homo sapiens
  Payload ID: 13175
  Gene Symbol: PRDM10
  Gene Name: PR domain containing 10
  ENSP ID: ENSP00000435940
MMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGS

SEQ ID NO: 66091 - protein, 115 aa, Homo sapiens
  Payload ID: 13175
  Gene Symbol: PRDM10
  Gene Name: PR domain containing 10
  ENSP ID: ENSP00000436681
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQETDFSMMKQTGTSSLSF

SEQ ID NO: 66092 - protein, 477 aa, Homo sapiens
  Payload ID: 13176
  Gene Symbol: PRDM11
  Gene Name: PR domain containing 11
  Uniprot ID: Q9NQV5
  ENSP ID: ENSP00000394314
MTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 66093 - protein, 184 aa, Homo sapiens
  Payload ID: 13176
  Gene Symbol: PRDM11
  Gene Name: PR domain containing 11
  ENSP ID: ENSP00000431898
MTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWM

SEQ ID NO: 66094 - protein, 511 aa, Homo sapiens
  Payload ID: 13176
  Gene Symbol: PRDM11
  Gene Name: PR domain containing 11
  Uniprot ID: Q9NQV5
  ENSP ID: ENSP00000435976
MLKMAEPIASLMIVECRACLRCSPLFLYQREKDRMTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 66095 - protein, 480 aa, Homo sapiens
  Payload ID: 13176
  Gene Symbol: PRDM11
  Gene Name: PR domain containing 11
  ENSP ID: ENSP00000456942
  MOD_RES (1)..(1): Any amino acid
XQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRNVAHLAERKRKPKFSKEELDILVTEVTHHEAVLFGRETMRLSHADRDKIWEGIARKITSVSQVPRSVKDIKHRWDDMKRRTKDKLAFMQQSLSGPGAGGRAPTIVLTAHERAIKSALLTARAGRGFPRAELDGTDSPSTSYDEDEEAPGPSRQPLRVPLQRSPEEEAHLARPALLRSSSSSDQSETVGPKPEALPHPSPQAQAACRTPRPHPSPPTTGLDWQLLHVHAQQTEVFRQFCQELVTVHRDMANSMHVIGQAMAELTSRVGQMCQTLTEIRDGVQASQRGPEGADPTGSTPQATQAQAPLPEPPPASPASAPTRTTRSRKRKHNF

SEQ ID NO: 66096 - protein, 1177 aa, Homo sapiens
  Payload ID: 13176
  Gene Symbol: PRDM11
  Gene Name: PR domain containing 11
  ENSP ID: ENSP00000480626
MTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAASESMVSGPAIMEDDDQEVDSADESVSNDMMTATDEPSKMSSATGRRIRRFKQEWLKKFWFLRYSPTLNEMWCHVCRQYTVQSSRTSAFIIGSKQFKIHTIKLHSQSNLHKKCLQLYKLRMHPEKTEEMCRNMTLLFNTAYHLALEGRPYLDFRPLAELLRKCELKVVDQYMNEGDCQILIHHIARALREDLVERIRQSPCLSVILDGQSDDLLADTVAVYVQYTSSDGPPATEFLSLQELGFSSTESYLQALDRAFSALGIRLQDEKPTVGLGVDGANITASLRASMFMTIRKTLPWLLCLPFMVHRPHLEILDAISGKELPCLEELENNLKQLLSFYRYSPRLMCELRSTAATLCEETEFLGDIRAVRWIIGEQNVLNALIKDYLEVVAHLKEVSSQTQRADASAIALALLQFLMDYQSIKLIYFLLDVIAVLSRLAYIFQGEYLLVSQVDDKIEEAIQEISRLADSPGEYLQEFEENFRESFNGIAMKNLRVAEAKFQSIREKICQKTQVILAQRFDSRSRIFVKACQVFDLAAWPRSSEELMSYGKEDMVQIFDHLEAIPTFSRDVCREGLDPRGSLLMEWRELKADYYTKNGFKDLISHICKYKQRFPLLNKIIQVLKVLPTSTACCEKGRNALQRVRKNHRSRLTLEQLSDLLTIAVNGPPITNFDAKRALDSWFEEKSGNSYALSAEVLSRMSALEQKPALQTMDHGTEFYPDI

SEQ ID NO: 66097 - protein, 367 aa, Homo sapiens
  Payload ID: 13177
  Gene Symbol: PRDM12
  Gene Name: PR domain containing 12
  Uniprot ID: Q9H4Q4
  ENSP ID: ENSP00000253008
MMGSVLPAEALVLKTGLKAPGLALAEVITSDILHSFLYGRWRNVLGEQLFEDKSHHASPKTAFTAEVLAQSFSGEVQKLSSLVLPAEVIIAQSSIPGEGLGIFSKTWIKAGTEMGPFTGRVIAPEHVDICKNNNLMWEVFNEDGTVRYFIDASQEDHRSWMTYIKCARNEQEQNLEVVQIGTSIFYKAIEMIPPDQELLVWYGNSHNTFLGIPGVPGLEEDQKKNKHEDFHPADSAAGPAGRMRCVICHRGFNSRSNLRSHMRIHTLDKPFVCRFCNRRFSQSSTLRNHVRLHTGERPYKCQVCQSAYSQLAGLRAHQKSARHRPPSTALQAHSPALPAPHAHAPALAAAAAAAAAAAAHHLPAMVL

SEQ ID NO: 66098 - protein, 121 aa, Homo sapiens
  Payload ID: 13178
  Gene Symbol: PRDM13
  Gene Name: PR domain containing 13
  ENSP ID: ENSP00000358216
MHGAARAPATSVSADCCIPAGLRLGPVPGTFKLGKYLSDRREPGPKKKVLTIQTSAHCAHGERGAGGRVGGLPSGVDRVNPGSQKLPGTDSGSYCRLTRRTDLLPSIARRPARGGADSVVF

SEQ ID NO: 66099 - protein, 707 aa, Homo sapiens
  Payload ID: 13178
  Gene Symbol: PRDM13
  Gene Name: PR domain containing 13
  Uniprot ID: Q9H4Q3
  ENSP ID: ENSP00000358217
MHGAARAPATSVSADCCIPAGLRLGPVPGTFKLGKYLSDRREPGPKKKVRMVRGELVDESGGSPLEWIGLIRAARNSQEQTLEAIADLPGGQIFYRALRDVQPGEELTVWYSNSLAQWFDIPTTATPTHDEKGEERYICWYCWRTFRYPNSLKAHLRFHCVFSGGGGGAFLHHEHAARQGAVPAADGLGLSPKPPAPDFAAPSQAGTLRPHPLGPPPVQACGAREGIKREASSAPSATSPTPGKWGQPKKGKEQLDRALDMSGAARGQGHFLGIVGGSSAGVGSLAFYPGVRSAFKPAGLARAAAAAHGDPYREESSSKQGAGLALGRLLGGGRACGRPGSGENSAAGGAGHHHHHHAHHHHHPKCLLAGDPPPPPPPGLPCSGALRGFPLLSVPPEEASAFKHVERAPPAAAALPGARYAQLPPAPGLPLERCALPPLDPGGLKAYPGGECSHLPAVMPAFTVYNGELLYGSPATTAYYPLKLHFGGLLKYPESISYFSGPAAAALSPAELGSLASIDREIAMHNQQLSEMAAGKGRGRLDSGTLPPAVAAAGGTGGGGSGGSGAGKPKTGHLCLYCGKLYSRKYGLKIHMRTHTGYKPLKCKVCLRPFGDPSNLNKHIRLHAEGNTPYRCEFCGKVLVRRRDLERHVKSRHPGQSLLAKAGDGPGAEPGYPPEPGDPKSDDSDVDVCFTDDQSDPEVGGGGERDL

SEQ ID NO: 66100 - protein, 571 aa, Homo sapiens
  Payload ID: 13179
  Gene Symbol: PRDM14
  Gene Name: PR domain containing 14
  Uniprot ID: Q9GZV8
  ENSP ID: ENSP00000276594
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLPPWYPIPHVPREVPPFLSSSHEYAGASSEDLGHQIIGGDNESGPCCGPDTLIPPPPADASLLPEGLRTSQLLPCSPSKQSEDGPKPSNQEGKSPARFQFTEEDLHFVLYGVTPSLEHPASLHHAISGLLVPPDSSGSDSLPQTLDKDSLQLPEGLCLMQTVFGEVPHFGVFCSSFIAKGVRFGPFQGKVVNASEVKTYGDNSVMWEIFEDGHLSHFIDGKGGTGNWMSYVNCARFPKEQNLVAVQCQGHIFYESCKEIHQNQELLVWYGDCYEKFLDIPVSLQVTEPGKQPSGPSEESAEGYRCERCGKVFTYKYYRDKHLKYTPCVDKGDRKFPCSLCKRSFEKRDRLRIHILHVHEKHRPHKCSTCGKCFSQSSSLNKHMRVHSGDRPYQCVYCTKRFTASSILRTHIRQHSGEKPFKCKYCGKSFASHAAHDSHVRRSHKEDDGCSCSICGKIFSDQETFYSHMKFHEDY

SEQ ID NO: 66101 - protein, 99 aa, Homo sapiens
  Payload ID: 13179
  Gene Symbol: PRDM14
  Gene Name: PR domain containing 14
  ENSP ID: ENSP00000408653
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLP

SEQ ID NO: 66102 - protein, 1507 aa, Homo sapiens
  Payload ID: 13180
  Gene Symbol: PRDM15
  Gene Name: PR domain containing 15
  Uniprot ID: P57071
  ENSP ID: ENSP00000269844
MPRRRPPASGAAQFPERIATRSPDPIPLCTFQRQPRAAPVQPPCRLFFVTFAGCGHRWRSESKPGWISRSRSGIALRAARPPGSSPPRPAAPRPPPPGGVVAEAPGDVVIPRPRVQPMRVARGGPWTPNPAFREAESWSQIGNQRVSEQLLETSLGNEVSDTEPLSPASAGLRRNPALPPGPFAQNFSWGNQENLPPALGKIANGGGTGAGKAECGYETESHLLEPHEIPLNVNTHKFSDCEFPYEFCTVCFSPFKLLGMSGVEGVWNQHSRSASMHTFLNHSATGIREAGCRKDMPVSEMAEDGSEEIMFIWCEDCSQYHDSECPELGPVVMVKDSFVLSRARSWPASGHVHTQAGQGMRGYEDRDRADPQQLPEAVPAGLVRRLSGQQLPCRSTLTWGRLCHLVAQGRSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 66103 - protein, 1178 aa, Homo sapiens
  Payload ID: 13180
  Gene Symbol: PRDM15
  Gene Name: PR domain containing 15
  Uniprot ID: P57071
  ENSP ID: ENSP00000381556
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 66104 - protein, 478 aa, Homo sapiens
  Payload ID: 13180
  Gene Symbol: PRDM15
  Gene Name: PR domain containing 15
  ENSP ID: ENSP00000387958
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTATSPSTRRSTATRSLPVRSAARCSTARTSCWTTSAGTWKECGE

SEQ ID NO: 66105 - protein, 1141 aa, Homo sapiens
  Payload ID: 13180
  Gene Symbol: PRDM15
  Gene Name: PR domain containing 15
  ENSP ID: ENSP00000390245
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 66106 - protein, 555 aa, Homo sapiens
  Payload ID: 13180
  Gene Symbol: PRDM15
  Gene Name: PR domain containing 15
  Uniprot ID: P57071
  ENSP ID: ENSP00000396943
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPATSPSTRRSTATRSLPVRSAARCSTARTSCWTTSAGTWKECGE

SEQ ID NO: 66107 - protein, 1198 aa, Homo sapiens
  Payload ID: 13180
  Gene Symbol: PRDM15
  Gene Name: PR domain containing 15
  Uniprot ID: P57071
  ENSP ID: ENSP00000408592
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 66108 - protein, 1507 aa, Homo sapiens; identical to SEQ ID NO: 66102
  Payload ID: 13180
  Gene Symbol: PRDM15
  Gene Name: PR domain containing 15
  Uniprot ID: P57071
  ENSP ID: ENSP00000415471

SEQ ID NO: 66109 - protein, 1141 aa, Homo sapiens; identical to SEQ ID NO: 66105
  Payload ID: 13180
  Gene Symbol: PRDM15
  Gene Name: PR domain containing 15
  ENSP ID: ENSP00000431410

SEQ ID NO: 66110 - protein, 1276 aa, Homo sapiens
  Payload ID: 13181
  Gene Symbol: PRDM16
  Gene Name: PR domain containing 16
  Uniprot ID: Q9HAZ2
  ENSP ID: ENSP00000270722
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 66111 - protein, 1257 aa, Homo sapiens
  Payload ID: 13181
  Gene Symbol: PRDM16
  Gene Name: PR domain containing 16
  Uniprot ID: Q9HAZ2
  ENSP ID: ENSP00000367643
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQGSLDAWLKVTGATSESGAFHPINHL

SEQ ID NO: 66112 - protein, 1177 aa, Homo sapiens
  Payload ID: 13181
  Gene Symbol: PRDM16
  Gene Name: PR domain containing 16
  ENSP ID: ENSP00000421400
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKQISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRHMQ

SEQ ID NO: 66113 - protein, 1084 aa, Homo sapiens
  Payload ID: 13181
  Gene Symbol: PRDM16
  Gene Name: PR domain containing 16
  ENSP ID: ENSP00000425796
IYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 66114 - protein, 1178 aa, Homo sapiens
  Payload ID: 13181
  Gene Symbol: PRDM16
  Gene Name: PR domain containing 16
  ENSP ID: ENSP00000426975
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKQISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRHMQ

SEQ ID NO: 66115 - protein, 53 aa, Homo sapiens
  Payload ID: 13181
  Gene Symbol: PRDM16
  Gene Name: PR domain containing 16
  ENSP ID: ENSP00000476002
TKISEDLGSEKFCVDANQAGAGSWLKYIRVACSCDDQNLTMCQISEQMKVKLE

SEQ ID NO: 66116 - protein, 1718 aa, Homo sapiens
  Payload ID: 13182
  Gene Symbol: PRDM2
  Gene Name: PR domain containing 2, with ZNF domain
  Uniprot ID: Q13029
  ENSP ID: ENSP00000235372
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFSYSLRLASRCSPPAAPYITRQYRKVKAPAAAQFQGPFFKE

SEQ ID NO: 66117 - protein, 1682 aa, Homo sapiens
  Payload ID: 13182
  Gene Symbol: PRDM2
  Gene Name: PR domain containing 2, with ZNF domain
  Uniprot ID: Q13029
  ENSP ID: ENSP00000312352
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 66118 - protein, 1481 aa, Homo sapiens
  Payload ID: 13182
  Gene Symbol: PRDM2
  Gene Name: PR domain containing 2, with ZNF domain
  Uniprot ID: Q13029
  ENSP ID: ENSP00000341621
MRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 66119 - protein, 226 aa, Homo sapiens
  Payload ID: 13182
  Gene Symbol: PRDM2
  Gene Name: PR domain containing 2, with ZNF domain
  Uniprot ID: Q13029
  ENSP ID: ENSP00000365216
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKATASAWRPDALHQRPRTSPGSIGRSKLQLQPSSRDHSSKSRHSGCSLTAPEVTWNQ

SEQ ID NO: 66120 - protein, 78 aa, Homo sapiens
  Payload ID: 13182
  Gene Symbol: PRDM2
  Gene Name: PR domain containing 2, with ZNF domain
  ENSP ID: ENSP00000384430
MRDSAEGPKEDEEKPSASALEQPATLQEVASQEVPPELATPAPAWEPQPEPDERLEAAACEVNDLGEEEEEEEEEDEE

SEQ ID NO: 66121 - protein, 1481 aa, Homo sapiens; identical to SEQ ID NO: 66118
  Payload ID: 13182
  Gene Symbol: PRDM2
  Gene Name: PR domain containing 2, with ZNF domain
  Uniprot ID: Q13029
  ENSP ID: ENSP00000411103

SEQ ID NO: 66122 - protein, 153 aa, Homo sapiens
  Payload ID: 13182
  Gene Symbol: PRDM2
  Gene Name: PR domain containing 2, with ZNF domain
  ENSP ID: ENSP00000423010
MNQNTTEPVAATETLAEVPEHVLRGLPEEVRLFPSAVDKTRIGVWATKPILKGKKFGPFVGDKKKRSQVYYPNLGWMCIDATDPEKGNWLRYVNWACSGEEQNLFPLEINRAIYYKTLKPIAPGEELLVWYNGEDNPEIAAAIEEERASARSK

SEQ ID NO: 66123 - protein, 44 aa, Homo sapiens
  Payload ID: 13182
  Gene Symbol: PRDM2
  Gene Name: PR domain containing 2, with ZNF domain
  ENSP ID: ENSP00000424253
AATETLAEVPEHVLRGLPEEVRLFPSAVDKTRIGVLPKFGMDVH

SEQ ID NO: 66124 - protein, 62 aa, Homo sapiens
  Payload ID: 13182
  Gene Symbol: PRDM2
  Gene Name: PR domain containing 2, with ZNF domain
  ENSP ID: ENSP00000425028
MRDSAEATASAWRPDALHQRPRTSPGSIGRSKLQLQPSSRDHSSKSRHSGCSLTAPEVTWNQ

SEQ ID NO: 66125 - protein, 62 aa, Homo sapiens; identical to SEQ ID NO: 66124
  Payload ID: 13182
  Gene Symbol: PRDM2
  Gene Name: PR domain containing 2, with ZNF domain
  ENSP ID: ENSP00000426737

SEQ ID NO: 66126 - protein, 21 aa, Homo sapiens
  Payload ID: 13182
  Gene Symbol: PRDM2
  Gene Name: PR domain containing 2, with ZNF domain
  ENSP ID: ENSP00000474273
MRDSAEGPKEDEEKPSASALE

SEQ ID NO: 66127 - protein, 801 aa, Homo sapiens
  Payload ID: 13183
  Gene Symbol: PRDM4
  Gene Name: PR domain containing 4
  Uniprot ID: Q9UKN5
  ENSP ID: ENSP00000228437
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 66128 - protein, 316 aa, Homo sapiens
  Payload ID: 13183
  Gene Symbol: PRDM4
  Gene Name: PR domain containing 4
  ENSP ID: ENSP00000446803
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSGVLCVTAPIPRTVPNMDQ

SEQ ID NO: 66129 - protein, 75 aa, Homo sapiens
  Payload ID: 13183
  Gene Symbol: PRDM4
  Gene Name: PR domain containing 4
  ENSP ID: ENSP00000448684
MHHRMNEMNLSPVGMEQLTSSSVSNALPVSGSHLGLAASPTHSAIPAPGLPVAIPNLGPSLSSLPSALSLMLPMG

SEQ ID NO: 66130 - protein, 279 aa, Homo sapiens
  Payload ID: 13183
  Gene Symbol: PRDM4
  Gene Name: PR domain containing 4
  ENSP ID: ENSP00000449295
PMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVVGVLPLTGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFY

SEQ ID NO: 66131 - protein, 630 aa, Homo sapiens
  Payload ID: 13184
  Gene Symbol: PRDM5
  Gene Name: PR domain containing 5
  Uniprot ID: Q9NQX1
  ENSP ID: ENSP00000264808
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHVLQCTAKSSLKESSRSFQCSVCNSSFSSASSFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 66132 - protein, 111 aa, Homo sapiens
  Payload ID: 13184
  Gene Symbol: PRDM5
  Gene Name: PR domain containing 5
  Uniprot ID: Q9NQX1
  ENSP ID: ENSP00000377955
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQDKNLGPAEWRG

SEQ ID NO: 66133 - protein, 599 aa, Homo sapiens
  Payload ID: 13184
  Gene Symbol: PRDM5
  Gene Name: PR domain containing 5
  Uniprot ID: Q9NQX1
  ENSP ID: ENSP00000404832
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 66134 - protein, 501 aa, Homo sapiens
  Payload ID: 13184
  Gene Symbol: PRDM5
  Gene Name: PR domain containing 5
  Uniprot ID: Q9NQX1
  ENSP ID: ENSP00000422309
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGEAVQVLRVQQGLQPEARPG

SEQ ID NO: 66135 - protein, 145 aa, Homo sapiens
  Payload ID: 13184
  Gene Symbol: PRDM5
  Gene Name: PR domain containing 5
  ENSP ID: ENSP00000424861
  MOD_RES (1)..(1): Any amino acid
XKDRLGCKEDYACPQCESSFTSEDILAEHLQTLHQKPTEEKEFKCKNCGKKFPVKQALQRHVLQCTAKSSLKESSRSFQCSVCNSSFSSASSFEQHQETCRGDARFVCKADSCGKRLKSKDALKRHQENVHTVLVHGKVKGLFYI

SEQ ID NO: 66136 - protein, 595 aa, Homo sapiens
  Payload ID: 13185
  Gene Symbol: PRDM6
  Gene Name: PR domain containing 6
  Uniprot ID: Q9NQX0
  ENSP ID: ENSP00000384725
MLKPGDPGGSAFLKVDPAYLQHWQQLFPHGGAGPLKGSGAAGLLSAPQPLQPPPPPPPPERAEPPPDSLRPRPASLSSASSTPASSSTSASSASSCAAAAAAAALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEIYDQDGTLQHFIDGGEPSKSSWMRYIRCARHCGEQNLTVVQYRSNIFYRACIDIPRGTELLVWYNDSYTSFFGIPLQCIAQDENLNVPSTVMEAMCRQDALQPFNKSSKLAPTTQQRSVVFPQTPCSRNFSLLDKSGPIESGFNQINVKNQRVLASPTSTSQLHSEFSDWHLWKCGQCFKTFTQRILLQMHVCTQNPDRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 66137 - protein, 73 aa, Homo sapiens
  Payload ID: 13185
  Gene Symbol: PRDM6
  Gene Name: PR domain containing 6
  ENSP ID: ENSP00000390919
  MOD_RES (1)..(1): Any amino acid
XAAAAPPPELPEWLRDLPREVCLCTSTVPGLAYGICAAQRIQQGTWIGPFQGVLLPPEKVQAGAVRNTQHLWE

SEQ ID NO: 66138 - protein, 492 aa, Homo sapiens
  Payload ID: 13186
  Gene Symbol: PRDM7
  Gene Name: PR domain containing 7
  Uniprot ID: Q9NQW5
  ENSP ID: ENSP00000396732
MSPERSQEESPEGDTERTERKPMVKDAFKDISIYFTKEEWAEMGDWEKTRYRNVKMNYNALITVGLRATRPAFMCHRRQAIKLQVDDTEDSDEEWTPRQQVKPPWMAFRGEQSKHQKGMPKASFNNESSLRELSGTPNLLNTSDSEQAQKPVSPPGEASTSGQHSRLKLELRRKETEGKMYSLRERKGHAYKEISEPQDDDYLYCEMCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRYVNCARDDEEQNLVAFQYHRQIFYRTCRVIRPGCELLVWSGDEYGQELGIRSSIEPAESLGQAVNCWSGMGMSMARNWASSGAASGRKSSWQGENQSQRSIHVPHAVWPFQVKNFSVNMWNAITPLRTSQDHLQENFSNQRIPAQGIRIRSGNILIHAAVMTKPKVKRSKKGPNS

SEQ ID NO: 66139 - protein, 138 aa, Homo sapiens
  Payload ID: 13186
  Gene Symbol: PRDM7
  Gene Name: PR domain containing 7
  ENSP ID: ENSP00000455390
MSPERSQEESPEGDTERTERKPMVKDAFKDISIYFTKEEWAEMGDWEKTRYRNVKMNYNALITVGLRATRPAFMCHRRQAIKLQVDDTEDSDEEWTPRQQVKPPWMAFRGEQSKHQKIVRCVRTSSLTAVLLMGPLHL

SEQ ID NO: 66140 - protein, 73 aa, Homo sapiens
  Payload ID: 13186
  Gene Symbol: PRDM7
  Gene Name: PR domain containing 7
  ENSP ID: ENSP00000457667
MSPERSQEESPEGDTERTERKPMVSEPLDQLSCVTEGRPSNSRWMTQKIPMKNGHLGSKTEFRSCHPGWSAMA

SEQ ID NO: 66141 - protein, 689 aa, Homo sapiens
  Payload ID: 13187
  Gene Symbol: PRDM8
  Gene Name: PR domain containing 8
  Uniprot ID: Q9NQV8
  ENSP ID: ENSP00000339764
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 66142 - protein, 689 aa, Homo sapiens; identical to SEQ ID NO: 66141
  Payload ID: 13187
  Gene Symbol: PRDM8
  Gene Name: PR domain containing 8
  Uniprot ID: Q9NQV8
  ENSP ID: ENSP00000406998

SEQ ID NO: 66143 - protein, 689 aa, Homo sapiens; identical to SEQ ID NO: 66141
  Payload ID: 13187
  Gene Symbol: PRDM8
  Gene Name: PR domain containing 8
  Uniprot ID: Q9NQV8
  ENSP ID: ENSP00000423985

SEQ ID NO: 66144 - protein, 427 aa, Homo sapiens
  Payload ID: 13187
  Gene Symbol: PRDM8
  Gene Name: PR domain containing 8
  ENSP ID: ENSP00000425149
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAA

SEQ ID NO: 66145 - protein, 894 aa, Homo sapiens
  Payload ID: 13188
  Gene Symbol: PRDM9
  Gene Name: PR domain containing 9
  Uniprot ID: Q9NQV7
  ENSP ID: ENSP00000296682
MSPEKSQEESPEEDTERTERKPMVKDAFKDISIYFTKEEWAEMGDWEKTRYRNVKRNYNALITIGLRATRPAFMCHRRQAIKLQVDDTEDSDEEWTPRQQVKPPWMALRVEQRKHQKGMPKASFSNESSLKELSRTANLLNASGSEQAQKPVSPSGEASTSGQHSRLKLELRKKETERKMYSLRERKGHAYKEVSEPQDDDYLYCEMCQNFFIDSCAAHGPPTFVKDSAVDKGHPNRSALSLPPGLRIGPSGIPQAGLGVWNEASDLPLGLHFGPYEGRITEDEEAANNGYSWLITKGRNCYEYVDGKDKSWANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQEQQYPDPHSRNDKTKGQEIKERSKLLNKRTWQREISRAFSSPPKGQMGSCRVGKRIMEEESRTGQKVNPGNTGKLFVGVGISRIAKVKYGECGQGFSVKSDVITHQRTHTGEKLYVCRECGRGFSWKSHLLIHQRIHTGEKPYVCRECGRGFSWQSVLLTHQRTHTGEKPYVCRECGRGFSRQSVLLTHQRRHTGEKPYVCRECGRGFSRQSVLLTHQRRHTGEKPYVCRECGRGFSWQSVLLTHQRTHTGEKPYVCRECGRGFSWQSVLLTHQRTHTGEKPYVCRECGRGFSNKSHLLRHQRTHTGEKPYVCRECGRGFRDKSHLLRHQRTHTGEKPYVCRECGRGFRDKSNLLSHQRTHTGEKPYVCRECGRGFSNKSHLLRHQRTHTGEKPYVCRECGRGFRNKSHLLRHQRTHTGEKPYVCRECGRGFSDRSSLCYHQRTHTGEKPYVCREDE

SEQ ID NO: 66146 - protein, 100 aa, Homo sapiens
  Payload ID: 13188
  Gene Symbol: PRDM9
  Gene Name: PR domain containing 9
  ENSP ID: ENSP00000425471
MSPEKSQEESPEEDTERTERKPMVKDAFKDISIYFTKEEWAEMGDWEKTRYRNVKRNYNALITIGLRATRPAFMCHRRQAIKLQVDDTEDSDEEWTPRQQ

SEQ ID NO: 66147 - protein, 411 aa, Homo sapiens
  Payload ID: 13188
  Gene Symbol: PRDM9
  Gene Name: PR domain containing 9
  ENSP ID: ENSP00000489227
MPPYPGLRATRPAFMCHRRQAIKLQVDDTEDSDEEWTPRQQVKPPWMALRVEQRKHQKGMPKASFSNESSLKELSRTANLLNASGSEQAQKPVSPSGEASTSGQHSRLKLELRKKETERKMYSLRERKGHAYKEVSEPQDDDYLYCEMCQNFFIDSCAAHGPPTFVKDSAVDKGHPNRSALSLPPGLRIGPSGIPQAGLGVWNEASDLPLGLHFGPYEGRITEDEEAANNGYSWLITKGRNCYEYVDGKDKSWANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQEQQYPDPHSRNDKTKGQEIKERSKLLNKRTWQR

SEQ ID NO: 66148 - protein, 160 aa, Homo sapiens
  Payload ID: 13189
  Gene Symbol: PRAF2
  Gene Name: PRA1 domain family, member 2
  ENSP ID: ENSP00000365566
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLRESPLPRDSQESSQSMLKAPGQPCRSPG

SEQ ID NO: 66149 - protein, 178 aa, Homo sapiens
  Payload ID: 13189
  Gene Symbol: PRAF2
  Gene Name: PRA1 domain family, member 2
  Uniprot ID: O60831
  ENSP ID: ENSP00000451962
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 66150 - protein, 643 aa, Homo sapiens
  Payload ID: 13190
  Gene Symbol: PJA1
  Gene Name: praja ring finger 1, E3 ubiquitin protein ligase
  Uniprot ID: Q8NG27
  ENSP ID: ENSP00000355014
MGQESSKPVWPNPTGGYQSNTGRRYGRRHAYVSFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 66151 - protein, 588 aa, Homo sapiens
  Payload ID: 13190
  Gene Symbol: PJA1
  Gene Name: praja ring finger 1, E3 ubiquitin protein ligase
  Uniprot ID: Q8NG27
  ENSP ID: ENSP00000363699
MHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 66152 - protein, 643 aa, Homo sapiens; identical to SEQ ID NO: 66150
  Payload ID: 13190
  Gene Symbol: PJA1
  Gene Name: praja ring finger 1, E3 ubiquitin protein ligase
  Uniprot ID: Q8NG27
  ENSP ID: ENSP00000363711

SEQ ID NO: 66153 - protein, 455 aa, Homo sapiens
  Payload ID: 13190
  Gene Symbol: PJA1
  Gene Name: praja ring finger 1, E3 ubiquitin protein ligase
  Uniprot ID: Q8NG27
  ENSP ID: ENSP00000363712
MGQESSKPVWPNPTGGYQSNTGRRYGRRHAYVSFRPPTSQRERIASQRKTNSEVPMHRSAPSQTTKRSRSPFSTTRRSWDDSESSGTNLNIDNEDYSSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 66154 - protein, 144 aa, Homo sapiens
  Payload ID: 13190
  Gene Symbol: PJA1
  Gene Name: praja ring finger 1, E3 ubiquitin protein ligase
  ENSP ID: ENSP00000467404
MGQESSKPVWPNPTGGYQSNTGRRYGRRHAYVSFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTG

SEQ ID NO: 66155 - protein, 67 aa, Homo sapiens
  Payload ID: 13190
  Gene Symbol: PJA1
  Gene Name: praja ring finger 1, E3 ubiquitin protein ligase
  ENSP ID: ENSP00000467564
  MOD_RES (1)..(1): Any amino acid
XDPVPAARCSASRADFLPQSSVASQSSSEGKLATKGDSSERERREQNLPARALLKLTMEIKPISQLA

SEQ ID NO: 66156 - protein, 708 aa, Homo sapiens
  Payload ID: 13191
  Gene Symbol: PJA2
  Gene Name: praja ring finger 2, E3 ubiquitin protein ligase
  Uniprot ID: O43164
  ENSP ID: ENSP00000354775
MSQYTEKEPAAMDQESGKAVWPKPAGGYQTITGRRYGRRHAYVSFKPCMTRHERSLGRAGDDYEVLELDDVPKENSSGSSPLDQVDSSLPSEPIFEKSETEIPTCGSALNQTTESSQSFVAVHHSEEGRDTLGSSTNLHNHSEGEYIPGACSASSVQNGIALVHTDSYDPDGKHGEDNDHLQLSAEVVEGSRYQESLGNTVFELENREAEAYTGLSPPVPSFNCEVRDEFEELDSVPLVKSSAGDTEFVHQNSQEIQRSSQDEMVSTKQQNNTSQERQTEHSPEDAACGPGHICSEQNTNDREKNHGSSPEQVVRPKVRKLISSSQVDQETGFNRHEAKQRSVQRWREALEVEESGSDDLLIKCEEYDGEHDCMFLDPPYSRVITQRETENNQMTSESGATAGRQEVDNTFWNGCGDYYQLYDKDEDSSECSDGEWSASLPHRFSGTEKDQSSSDESWETLPGKDENEPELQSDSSGPEEENQELSLQEGEQTSLEEGEIPWLQYNEVNESSSDEGNEPANEFAQPAFMLDGNNNLEDDSSVSEDLDVDWSLFDGFADGLGVAEAISYVDPQFLTYMALEERLAQAMETALAHLESLAVDVEVANPPASKESIDGLPETLVLEDHTAIGQEQCCPICCSEYIKDDIATELPCHHFFHKPCVSIWLQKSGTCPVCRRHFPPAVIEASAAPSSEPDPDAPPSNDSIAEAP

SEQ ID NO: 66157 - protein, 708 aa, Homo sapiens; identical to SEQ ID NO: 66156
  Payload ID: 13191
  Gene Symbol: PJA2
  Gene Name: praja ring finger 2, E3 ubiquitin protein ligase
  Uniprot ID: O43164
  ENSP ID: ENSP00000355284

SEQ ID NO: 66158 - protein, 474 aa, Homo sapiens
  Payload ID: 13192
  Gene Symbol: PRAMEF1
  Gene Name: PRAME family member 1
  Uniprot ID: O95521
  ENSP ID: ENSP00000332134
MSIQAPPRLLELAGQSLLRDQALSISAMEELPRVLYLPLFMEAFSRRHFQTLTVMVQAWPFTCLPLGSLMKTLHLETLKALLEGLHMLLTQKDRPRRWKLQVLDLRDVDENFWARWPGAWALSCFPETTSKRQTAEDCPRMGEHQPLKVFIDICLKEIPQDECLRYLFQWVYQRRGLVHLCCSKLVNYLTPIKYLRKSLKIIYLNSIQELEIRNMSWPRLIRKLRCYLKEMKNLRKLVFSRCHHYTSDNELEGRLVAKFSSVFLRLEHLQLLKIKLITFFSGHLEQLIRCLQNPLENLELTYGYLLEEDMKCLSQYPSLGYLKHLNLSYVLLFRISLEPLGALLEKIAASLKTLILEGCQIHYSQLSAILPGLSRCSQLTTFYFGRNCMSIDALKDLLRHTSGLSKLSLETYPAPEESLNSLVRVNWEIFTPLRAELMCTLREVRQPKRIFIGPTPCPSCGSSPSEELELHLCC

SEQ ID NO: 66159 - protein, 474 aa, Homo sapiens
  Payload ID: 13193
  Gene Symbol: PRAMEF10
  Gene Name: PRAME family member 10
  Uniprot ID: O60809
  ENSP ID: ENSP00000235347
MSLQAPSRLLELAGQSLLRNQFLTIFTLDELPREVFPLMFMEAFSMRRFEALKLMVQAWPFLRLPLGSLMKTPHLETLQAVLRGLDTLVAQKVRPRRWKLQVLDLRDVDENFWTIWSGARVLSCSPEAMSKRQTVEDCPRMGERQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQWPCIPDLDSPFLCLYYPQMLYIKKISNIKEHLEHLLRYLKNPLGAFIFSDAYLTDRDMECLSQYPSLSQLKELRLIHILMWTTNLEPLGVLLEKVAATLKTLVLKDCRIQDPQLRVLLPALSHCSQLTTFNFHGNETSMNALKDLLRHTRGLSKLGLELYPAPLESLDYKGHVNWEILTPIRAELMRTLREVRQPKRIFFGPVPCPNCGSWPSEKVDFHLCS

SEQ ID NO: 66160 - protein, 474 aa, Homo sapiens; identical to SEQ ID NO: 66159
  Payload ID: 13193
  Gene Symbol: PRAMEF10
  Gene Name: PRAME family member 10
  ENSP ID: ENSP00000488485

SEQ ID NO: 66161 - protein, 478 aa, Homo sapiens
  Payload ID: 13194
  Gene Symbol: PRAMEF11
  Gene Name: PRAME family member 11
  ENSP ID: ENSP00000480027
MKMSIRIPPRLLELAGRSLLRDQALAVSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKKPVQDCPRMRGRQPLTVFVELWLKNRTLDEYLTCLLLWVKQRRDLLHLCCKKLKILGMPFRNIRSILKMVNLDCIQEVEVNCKWILPILTQFTPYLGHLRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCLELYPAPQESYGADGTLCWSRFAQIRAELMKKVRHLRHPKRILFCTDNCPDHGDRSFYDLEADQYCC

SEQ ID NO: 66162 - protein, 478 aa, Homo sapiens; identical to SEQ ID NO: 66161
  Payload ID: 13194
  Gene Symbol: PRAMEF11
  Gene Name: PRAME family member 11
  ENSP ID: ENSP00000488512

SEQ ID NO: 66163 - protein, 483 aa, Homo sapiens
  Payload ID: 13195
  Gene Symbol: PRAMEF12
  Gene Name: PRAME family member 12
  Uniprot ID: O95522
  ENSP ID: ENSP00000350358
MSLQAPPRLLELAEQSLLRDRALAIPTLEELPRELFPPLFMEAFTRRCCETLTTMVQAWPFTCLPLGSLMKSCNLEIFRAVLEGLDALLAQKVRPRRWKLQVLDLRNVDENFWGIWSGASALSPEALSKRRTAGNCPRPGGQQPLMVILDLCFKNGTLDECLTHFLEWGKQRKGLLHVCCKELQIFGIAIHRIIEVLNTVELDCIQEVEVCCPWELSILIRFAPYLGQMRNLRKLVLFNIHVSACIPLDRKEQFVIQFTSQFLKLDYFQKLYMHSVSFLEGHLDQLLRCLQAPLETVVMTECLLSESDLKHLSWCPSIRQLKELDLRGITLTHFSPEPLSVLLEQAEATLQTLDLEDCGIVDSQLSAILPALSRCSQLSTFSFCGNLISMAALENLLRHTVGLSKLSLELYPAPLESYDAQGALCWGRFSQLGAELMKTLRDLRQPKIIVFSTVPCPRCGIRASYDLEPSHCLLNACCQGGFI

SEQ ID NO: 66164 - protein, 474 aa, Homo sapiens
  Payload ID: 13196
  Gene Symbol: PRAMEF14
  Gene Name: PRAME family member 14
  ENSP ID: ENSP00000334410
MSIQAPPRLLELAGQSLLRDQALSISAMEELPRVLYLPLFMEAFRRRHFQTLTVMVQAWPFTCLPLGSLMKTLHLETLKALLEGLHMLLTQKDRPRRWKLQVLDLRDVDENFWARWPGAWALSCFPETMSKRQTAEDCPRMGEHQPLKVFIDICLKEIPQDECLRYLFQWVYQRRGLVHLCCSKLVNYLTPIKHLRKSLKIIYLNSIQQLEIRNMSWPRLIRKLRCYLKEMKNLRKLVFSRCHHSMSDNELEGRLVTKFSSVFLRLEHLQLLKIKLITFFSGHLEQLIRCLQNPLENLELTYGYLLEEDMKCLSQYPSLGYLKHLNLSYVLLFRISLEPLGALLEKIAASLETLILEGCQIHYSQLSAILPGLSHCSQLTTFYFGRNCMSMGALKDLLCHTSGLSKLSLETYPAPEESLNSLVRVDWEIFALLRAELMCTLREVRQPKRIFIGPTPCPSCGSSPSEELELHLCC

SEQ ID NO: 66165 - protein, 478 aa, Homo sapiens
  Payload ID: 13197
  Gene Symbol: PRAMEF15
  Gene Name: PRAME family member 15
  Uniprot ID: Q5VWM5
  ENSP ID: ENSP00000365322
MKMSIRTPPRLLELAGRSLLRDQALAMSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKKPVQDCPRMRGRQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 66166 - protein, 476 aa, Homo sapiens
  Payload ID: 13197
  Gene Symbol: PRAMEF15
  Gene Name: PRAME family member 15
  ENSP ID: ENSP00000484000
MSIRTPPRLLELAGRSLLRDQALAMSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKKPVQDCPRMRGRQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 66167 - protein, 474 aa, Homo sapiens
  Payload ID: 13198
  Gene Symbol: PRAMEF17
  Gene Name: PRAME family member 17
  Uniprot ID: Q5VTA0
  ENSP ID: ENSP00000365266
MSLQSPSRLLELAGQSLLRNQFLTIFILDELPREVFPLMFMEASSMRHFEALKLMVQAWPFLRLPLGSLMKTPHLETLQAVLKGLDTLLAQKLRPRRWKLQVLDLRDVDGNFWTIWSGARALSCSPEAMSKRQTVEDYPRTGEHQPLKVFIDLCQKESTLDECLSYLCRWIHYRRGLVHLCCNKVQNYSMPTSSFRNLLKRVYPDSIQELEIKRKCSLNKTGKFAPYLSQMSNLRKLFLAFGYDDELYVSGQQQFVPDLDCPFLCLYYPQMLYIRKISNIKEHLEHLLRCLKNPLGTFIFCHAYLADQDMECLSQYPSLSQLKELHLIHILMWTTNLEPLGALLEKVAATLEILTLKDCQIQDSQLRVLLPALSRCSQLTTFYFRGNETSTNALKDLLCHTGGLSKLGLELYPAPLECLDNRGHVNWEILAPIRAELMCTLREVRQPKRIFFGPIPCPSCGSWPSEKVDFHLCS

SEQ ID NO: 66168 - protein, 479 aa, Homo sapiens
  Payload ID: 13199
  Gene Symbol: PRAMEF18
  Gene Name: PRAME family member 18
  ENSP ID: ENSP00000446004
MSFQAPRRLLELAGQSLLRDQALAISVLDELPRELFPPLFVEAFTSRRCEVLKVMVQAWPFPCLPLGSLMKTPDLEILHYVVDGIDCLLAQKVRPRRWKLQVLEMRDVDENFWTIWSGARLLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWLCMIVEFSRYLSQMRNLRKLFISDGCRYLLSSDSQEQLVAEFSSVLLRLENLQMLYVRRVCFFRGHLDQLIRCLRSPLETLALTYGFLEEEDLKCLPRYPSLSQLKQLNLSHGALRFIRLEPLRALLEKVAATLQTLFLVDCGIGYSKLRVILPALSRCSNLTTFCFHGNDTSMDALKDLLRHTGRLSNLSLETYPAPRESLDNRGRVILELLTPLQAELMRILREVREPKRIFFGPVSCPCCGTSPTEQLEFNFCLWGRPA

SEQ ID NO: 66169 - protein, 481 aa, Homo sapiens
  Payload ID: 13199
  Gene Symbol: PRAMEF18
  Gene Name: PRAME family member 18
  ENSP ID: ENSP00000485473
IRMSFQAPRRLLELAGQSLLRDQALAISVLDELPRELFPPLFVEAFTSRRCEVLKVMVQAWPFPCLPLGSLMKTPDLEILHYVVDGIDCLLAQKVRPRRWKLQVLEMRDVDENFWTIWSGARLLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWLCMIVEFSRYLSQMRNLRKLFISDGCRYLLSSDSQEQLVAEFSSVLLRLENLQMLYVRRVCFFRGHLDQLIRCLRSPLETLALTYGFLEEEDLKCLPRYPSLSQLKQLNLSHGALRFIRLEPLRALLEKVAATLQTLFLVDCGIGYSKLRVILPALSRCSNLTTFCFHGNDTSMDALKDLLRHTGRLSNLSLETYPAPRESLDNRGRVILELLTPLQAELMRILREVREPKRIFFGPVSCPCCGTSPTEQLESNFCLWGRPA

SEQ ID NO: 66170 - protein, 481 aa, Homo sapiens; identical to SEQ ID NO: 66169
  Payload ID: 13199
  Gene Symbol: PRAMEF18
  Gene Name: PRAME family member 18
  ENSP ID: ENSP00000488059

SEQ ID NO: 66171 - protein, 410 aa, Homo sapiens
  Payload ID: 13200
  Gene Symbol: PRAMEF19
  Gene Name: PRAME family member 19
  Uniprot ID: Q5SWL8
  ENSP ID: ENSP00000365269
MKTPDLEILHYVVDGIDCLLAQKVRPRRWKLQVLEMRDVDENFWTIWSGARPLSCSPEAMSKRQTVEDCPRTGEKQPLKVFMDVCLKEKSVDEDLSFFSGWVQHRRRSVHLCCTKVVNYSMNILNFRNILETVYPDSIQVLEIWNMCWPCMVAEVSRYLSQMKNLRKLFISDGCGYLPSFESQGQLVAEFSSVFLRLEYLQMLYMRRIRFFEGYLDQLIRCLKSPLETLALTYGSLDEEDLKCLPWYPSLSQLKQLNLSHGTLRFIRLEPLRALLEKVAATLQTLFLVDCGIGDSKLRVILPALSRCSNLTTFCFHGNDTSMDGLKDLLRHTGRLSNLSLETYPAPRESLDNRGRVISELLTPLQAELMRILREVREPNRIFFGPVSCPCCGMSPTEQLEFNFCLRGRPA

SEQ ID NO: 66172 - protein, 233 aa, Homo sapiens
  Payload ID: 13201
  Gene Symbol:
  Gene Name: PRAME family member 19 [Source:EntrezGene
  Acc:645414]
  ENSP ID: ENSP00000488623
VKEEKVHQTCAFHRGSSVLTLVNMNDPLSDSLSVKGCFELQERCLRSPLETLALTYGFLEEEDLKCLPRYPSLSQLKQLNLSHGALRFIRLEPLRALLEKVAATLQTLFLVDCGIGYSKLRVILPALSRCSNLTTFCFHGNDTSMDALKDLLRHTGRLSNLSLETYPAPRESLDNRGRVILELLTPLQAELMRILREVREPKRIFFGPVSCPCCGTSPTEQLEFNFCLWGRPA

SEQ ID NO: 66173 - protein, 479 aa, Homo sapiens
  Payload ID: 13201
  Gene Symbol:
  Gene Name: PRAME family member 19 [Source:EntrezGene
  Acc:645414]
  ENSP ID: ENSP00000488653
MSFQAPRRLLELAGQSLLRDQALAISVLDELPRELFPPLFVEAFTSRRCEVLKVMVQAWPFPCLPLGSLMKTPDLEILHYVVDGIDCLLAQKVRPRRWKLQVLEMRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWLCMIVEFSRYLSQMRNLRKLFISDGCRYLLSSDSQEQLVAEFSSVLLRLENLQMLYVRRVCFFRGHLDQLIRCLRSPLETLALTYGFLEEEDLKCLPRYPSLSQLKQLNLSHGALRFIRLEPLRALLEKVAATLQTLFLVDCGIGYSKLRVILPALSRCSNLTTFCFHGNDTSMDALKDLLRHTGRLSNLSLETYPAPRESLDNRGRVILELLTPLQAELMRILREVREPKRIFFGPVSCPCCGTSPTEQLEFNFCLWGRPA

SEQ ID NO: 66174 - protein, 474 aa, Homo sapiens
  Payload ID: 13202
  Gene Symbol: PRAMEF2
  Gene Name: PRAME family member 2
  Uniprot ID: O60811
  ENSP ID: ENSP00000240189
MSIQAPPRLLELAGQSLLRDQALSISAMEELPRVLYLPLFREAFSRRHFQTLTVMVQAWPFTCLPLVSLMKTLHLEPLKALLEGLHMLLTQKDRPRRWKLQVLDLRDVDENFWARWPGAWALSCFPEAMSKRQTAEDCPRTGEHQPLKVFIDICLKEIPQDECLRYLFQWVYQRRGLVHLCCSKLVNYLTPIKYLRKSLKIIYINSIGELEIHNTCWPHLIRKLYCYLKEMKTLCKLVFSRCHHYTSDNELEGWLVTRFTSVFLRLEHLQLLKIKLITFFSGHLEQLIRCLQNPLENLELTCGNLLEEDLKCLSQFPSLGYLKHLNLSYVLLFRISLEPLGALLEKIAASLETLVLEGCQIHYSQLSAILPGLSCCSQLTTFYFGSNCMSIDALKDLLRHTSGLSKLSLETYPAPEESLNSLVRVNWEIFTPLRAELMCTLREFRQPKRIFIGPTPCPSCGSSPSEELELHLCC

SEQ ID NO: 66175 - protein, 474 aa, Homo sapiens; identical to SEQ ID NO: 66174
  Payload ID: 13202
  Gene Symbol: PRAMEF2
  Gene Name: PRAME family member 2
  Uniprot ID: O60811
  ENSP ID: ENSP00000487743

SEQ ID NO: 66176 - protein, 475 aa, Homo sapiens
  Payload ID: 13203
  Gene Symbol: PRAMEF20
  Gene Name: PRAME family member 20
  Uniprot ID: Q5VT98
  ENSP ID: ENSP00000346275
MSIRTPPRLLELAGRSLLRDEALAISTLEELPTELFPPLFMEAFSRRHCEALKLMVQAWPFLRLPLGSLMKRPCPETFQAVLDGLDALLTHRVRLRRWKLQVLDLQDVSENFWMVWSEAMARRCLPNAMMNRKPLQDCPRMRGQQPLTVFIDLCLKNRTLDEYFTCLFLWVKQREGLVHLCCKKLKMLGMLFHNIRNILKTVNLDCIQEVEVNCNWTLPVLAEFTPYLGQMRNLRKLVLSDIDSRYISPEQKKEFVTQFTTQFLKLRCLQKLYMNSVSFLEGHLDQMLSCLKTSLNILAITNCVLLESDLKHLSKYPSIGQLKTLDLSGTRLANFSLVPLQVLLEKVAATLEYLDLDDCGIVDSQVNAILPALSRCFELTTFSFRGNPISTATLENLLCHTIRLNNLCLELYPAPRESYDVRGIVCRSRFAQLGAELMGRVRALREPERILFCTDYCPQCGNRSLYDLEVDRCCC

SEQ ID NO: 66177 - protein, 475 aa, Homo sapiens; identical to SEQ ID NO: 66176
  Payload ID: 13203
  Gene Symbol: PRAMEF20
  Gene Name: PRAME family member 20
  Uniprot ID: Q5VT98
  ENSP ID: ENSP00000473584

SEQ ID NO: 66178 - protein, 478 aa, Homo sapiens
  Payload ID: 13204
  Gene Symbol: PRAMEF25
  Gene Name: PRAME family member 25
  ENSP ID: ENSP00000487723
MKMSIRTPPRLLELAGRSVLRDQALAMSTLEELPTELFPPLFMEAFSRRRCEALKLMVQAWPFRRLPLRPLIKMPCLETFQAVLNGLDALLTHGVRPRRWKLQVLDLQDVCENFWMVWSEAMARGCFLNAKRNKKPVQDCPRMRGRQPLTVFVELWLKNRTLDEHLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCLELYPAPRESYGADGTLCWSRFAQIRAELMNRVRDLRHPKRIFFCIDNCPDCGNRSFYDLEADQYCC

SEQ ID NO: 66179 - protein, 478 aa, Homo sapiens
  Payload ID: 13204
  Gene Symbol: PRAMEF25
  Gene Name: PRAME family member 25
  Uniprot ID: A6NGN4
  ENSP ID: ENSP00000488002
MKMSIRTPPRLLELAGRSVLRDQALAMSTLEELPTELFPPLFMEAFSRRRCEALKLMVQAWPFRRLPLRPLIKMPCLETFQAVLNGLDALLTHGVRPRRWKLQVLDLQDVCENFWMVWSEAMARGCFLNAKRNKKPVQDCPRMRGRQPLTVFVELWLKNRTLDEHLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCLELYPAPRESYGADGTLCWSRFTQIRAELMKRVRDLRHPKRILFGTDYCPDCGNRSFYDLEADQYCC

SEQ ID NO: 66180 - protein, 478 aa, Homo sapiens; identical to SEQ ID NO: 66179
  Payload ID: 13205
  Gene Symbol:
  Gene Name: PRAME family member 25 [Source:EntrezGene
  Acc:441873]
  Uniprot ID: A6NGN4
  ENSP ID: ENSP00000478309

SEQ ID NO: 66181 - protein, 476 aa, Homo sapiens
  Payload ID: 13205
  Gene Symbol:
  Gene Name: PRAME family member 25 [Source:EntrezGene
  Acc:441873]
  ENSP ID: ENSP00000478972
MSIRTPPRLLELAGRSVLRDQALAMSTLEELPTELFPPLFMEAFSRRRCEALKLMVQAWPFRRLPLRPLIKMPCLETFQAVLNGLDALLTHGVRPRRWKLQVLDLQDVCENFWMVWSEAMARGCFLNAKRNKKPVQDCPRMRGRQPLTVFVELWLKNRTLDEHLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCLELYPAPRESYGADGTLCWSRFTQIRAELMKRVRDLRHPKRILFGTDYCPDCGNRSFYDLEADQYCC

SEQ ID NO: 66182 - protein, 436 aa, Homo sapiens
  Payload ID: 13205
  Gene Symbol:
  Gene Name: PRAME family member 25 [Source:EntrezGene
  Acc:441873]
  ENSP ID: ENSP00000480708
MEAFSRRRCEALKLMVQAWPFRRLPLRPLIKMPCLETFQAVLNGLDALLTHGVRPRRWKLQVLDLQDVCENFWMVWSEAMARGCFLNAKRNKKPVQDCPRMRGRQPLTVFVELWLKNRTLDEHLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCLELYPAPRESYGADGTLCWSRFTQIRAELMKRVRDLRHPKRILFGTDYCPDCGNRSFYDLEADQYCC

SEQ ID NO: 66183 - protein, 476 aa, Homo sapiens; identical to SEQ ID NO: 66181
  Payload ID: 13205
  Gene Symbol:
  Gene Name: PRAME family member 25 [Source:EntrezGene
  Acc:441873]
  ENSP ID: ENSP00000481674

SEQ ID NO: 66184 - protein, 478 aa, Homo sapiens; identical to SEQ ID NO: 66179
  Payload ID: 13205
  Gene Symbol:
  Gene Name: PRAME family member 25 [Source:EntrezGene
  Acc:441873]
  Uniprot ID: A6NGN4
  ENSP ID: ENSP00000481683

SEQ ID NO: 66185 - protein, 478 aa, Homo sapiens; identical to SEQ ID NO: 66179
  Payload ID: 13205
  Gene Symbol:
  Gene Name: PRAME family member 25 [Source:EntrezGene
  Acc:441873]
  Uniprot ID: A6NGN4
  ENSP ID: ENSP00000481973

SEQ ID NO: 66186 - protein, 476 aa, Homo sapiens; identical to SEQ ID NO: 66181
  Payload ID: 13205
  Gene Symbol:
  Gene Name: PRAME family member 25 [Source:EntrezGene
  Acc:441873]
  ENSP ID: ENSP00000487942

SEQ ID NO: 66187 - protein, 478 aa, Homo sapiens; identical to SEQ ID NO: 66179
  Payload ID: 13205
  Gene Symbol:
  Gene Name: PRAME family member 25 [Source:EntrezGene
  Acc:441873]
  Uniprot ID: A6NGN4
  ENSP ID: ENSP00000488003

SEQ ID NO: 66188 - protein, 478 aa, Homo sapiens; identical to SEQ ID NO: 66179
  Payload ID: 13205
  Gene Symbol:
  Gene Name: PRAME family member 25 [Source:EntrezGene
  Acc:441873]
  Uniprot ID: A6NGN4
  ENSP ID: ENSP00000488324

SEQ ID NO: 66189 - protein, 478 aa, Homo sapiens; identical to SEQ ID NO: 66178
  Payload ID: 13206
  Gene Symbol: PRAMEF26
  Gene Name: PRAME family member 26
  ENSP ID: ENSP00000484260

SEQ ID NO: 66190 - protein, 478 aa, Homo sapiens; identical to SEQ ID NO: 66179
  Payload ID: 13206
  Gene Symbol: PRAMEF26
  Gene Name: PRAME family member 26
  Uniprot ID: A6NGN4
  ENSP ID: ENSP00000485656

SEQ ID NO: 66191 - protein, 478 aa, Homo sapiens
  Payload ID: 13207
  Gene Symbol: PRAMEF27
  Gene Name: PRAME family member 27
  ENSP ID: ENSP00000393136
MKMSIRTPPRLLELAGRSLLRDQALAMSTLEELPTELFPPLFMEAFSRRCCEALKLMVQAWPFRRLPLRPLIKMPCLEAFQAVLDGLDALLTQGVCPRRWKLQVLDLQDVCENFWMVWSEAMARGSFLNAKRNKTPVQDCPRMRGQQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNAFSFCGNPISMATLENLLSHTIILKNLCVEVYPAPRESYGADGTLCWNRFAQIRAELMNRVRDLRHPKRIFFCIDNCPDCGNRSFYDLEADQYCC

SEQ ID NO: 66192 - protein, 478 aa, Homo sapiens; identical to SEQ ID NO: 66191
  Payload ID: 13207
  Gene Symbol: PRAMEF27
  Gene Name: PRAME family member 27
  ENSP ID: ENSP00000488085

SEQ ID NO: 66193 - protein, 474 aa, Homo sapiens
  Payload ID: 13208
  Gene Symbol: PRAMEF33P
  Gene Name: PRAME family member 33, pseudogene
  ENSP ID: ENSP00000479010
MSLQAPSRLLELAGQSLLRNQFLTIFTLDELPREVFPLMFMEAFSMRRFEALKLMVQAWPFLRLPLGSLMKTPHLETLQAVLRGLDTLVAQKVRPRRWKLQVLDLQDVDENFWTIWSGARVLSCSPEAMSKRQTVEDCPRMGEHQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQWPCIPDLDSPFLCLYYPQMLYIKKISNIKEHLEHLLRYLKNPLGAFIFSDAYLADRDMECLSQYPSLSQLKELRLIHILMWTTNLQPLGALLEKVAATLKTLVLKDCRIQDPQLRVLLPALSHCSQLTTFNFHGNETSMNALKDLLRHTRGLSKLGLELYPAPLESLDYKGHVNWEILTPIRAELMRTLREVRQPKRIFFGPVPCPTCGSWPSEKVDFHLCS

SEQ ID NO: 66194 - protein, 478 aa, Homo sapiens
  Payload ID: 13209
  Gene Symbol: PRAMEF4
  Gene Name: PRAME family member 4
  Uniprot ID: O60810
  ENSP ID: ENSP00000235349
MKMSIWTPPRLLELAGRSLLRDQALAMSTLEELPTELFPPLFMEAFSRRRCEALKLMVQSWPFRRLPLRPLIKMPCLEAFQAVLDGLDALLNLGVRPRRWKLQVLDLQDVCENFWMVWSEAMAHGCFLNAKRNKKPVEDCPRMKGRQPLTVFVELWLKNRTLDEYLTCLLLWVKQRKDLLHLCCKKLKILGMPFRNIRSILKMVNLDCIQEVEVNCKWVLPILTQFTPYLGHMRNLQKLILSHMDVSRYVSPEQKKEIVTQFTTQFLKLRCLQKLYMNSVSFLEGHLDQLLSCLKTSLKFLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 66195 - protein, 478 aa, Homo sapiens; identical to SEQ ID NO: 66194
  Payload ID: 13209
  Gene Symbol: PRAMEF4
  Gene Name: PRAME family member 4
  ENSP ID: ENSP00000488161

SEQ ID NO: 66196 - protein, 478 aa, Homo sapiens
  Payload ID: 13210
  Gene Symbol: PRAMEF5
  Gene Name: PRAME family member 5
  ENSP ID: ENSP00000478534
MKMSIRTPPRLLELAGRSLLRDQALAMSTLEELPTELFPPLFMEAFSRRCCEALKLMVQAWPFRRLPLRPLIKMPCLEAFQAVLDGLDALLTQGVCPRRWKLQVLDLQDVCENFWMVWSEAMAHGCFLNAKRNKKPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFPQIRAELMKRVRDLRHPKRILFCTDCCPDCGNRSFYDLEADQCCC

SEQ ID NO: 66197 - protein, 476 aa, Homo sapiens
  Payload ID: 13210
  Gene Symbol: PRAMEF5
  Gene Name: PRAME family member 5
  Uniprot ID: Q5TYX0
  ENSP ID: ENSP00000480122
MSIRTPPRLLELAGRSLLRDQALAMSTLEELPTELFPPLFMEAFSRRRCEALKLMVQAWPFRRLPLRPLIKMPCLEAFQAVLDGLDALLTQGVHPRRWKLQVLDLQDVCENFWMVWSEAMAHGCFLNAKRNKKPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFPQIRAELMKRVRDLRHPKRILFCTDCCPDCGNRSFYDLEADQCCC

SEQ ID NO: 66198 - protein, 476 aa, Homo sapiens; identical to SEQ ID NO: 66197
  Payload ID: 13210
  Gene Symbol: PRAMEF5
  Gene Name: PRAME family member 5
  Uniprot ID: Q5TYX0
  ENSP ID: ENSP00000482418

SEQ ID NO: 66199 - protein, 476 aa, Homo sapiens; identical to SEQ ID NO: 66197
  Payload ID: 13210
  Gene Symbol: PRAMEF5
  Gene Name: PRAME family member 5
  Uniprot ID: Q5TYX0
  ENSP ID: ENSP00000488527

SEQ ID NO: 66200 - protein, 476 aa, Homo sapiens
  Payload ID: 13211
  Gene Symbol: PRAMEF6
  Gene Name: PRAME family member 6
  Uniprot ID: Q5VXH4
  ENSP ID: ENSP00000365360
MSIRTPPRLLELAGRSLLRDQALAMSTLEELPTELFPPLFMEAFSRRRCEALKLMVQAWPFRRLPLRPLIKMPCLEAFQAVLDGLDALLTQGVHPRRWKLQVLDLQDVCENFWMVWSEAMARGCFLNAKRNKTPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFAQIRAELMKRVRDLRHPKRILFCTDCCPDCGNRSFYDLEADQCCC

SEQ ID NO: 66201 - protein, 476 aa, Homo sapiens; identical to SEQ ID NO: 66200
  Payload ID: 13211
  Gene Symbol: PRAMEF6
  Gene Name: PRAME family member 6
  Uniprot ID: Q5VXH4
  ENSP ID: ENSP00000401281

SEQ ID NO: 66202 - protein, 476 aa, Homo sapiens
  Payload ID: 13211
  Gene Symbol: PRAMEF6
  Gene Name: PRAME family member 6
  ENSP ID: ENSP00000479358
MSIRTPPRLLELAGRSLLRDQALAMSTLEELPTELFPPLFMEAFSRRCCEALKLMVQAWPFRRLPLRPLIKMPCLEAFQAVLDGLDALLTQGVCPRRWKLQVLDLQDVCENFWMVWSEAMARGCFLNAKRNKTPVQDCPRMRGQQPLTVFVELWLKNRTLDEYLTCLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLCCLQKLSMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPISMATLENLLSHTIILKNLCVELYPAPRESYDADGTLCWSRFAQIRAELMKRVRDLRHPKRILFCTDCCPDCGNRSFYDLEADQCCC

SEQ ID NO: 66203 - protein, 476 aa, Homo sapiens; identical to SEQ ID NO: 66200
  Payload ID: 13211
  Gene Symbol: PRAMEF6
  Gene Name: PRAME family member 6
  ENSP ID: ENSP00000487731

SEQ ID NO: 66204 - protein, 476 aa, Homo sapiens; identical to SEQ ID NO: 66202
  Payload ID: 13211
  Gene Symbol: PRAMEF6
  Gene Name: PRAME family member 6
  ENSP ID: ENSP00000487955

SEQ ID NO: 66205 - protein, 476 aa, Homo sapiens; identical to SEQ ID NO: 66200
  Payload ID: 13211
  Gene Symbol: PRAMEF6
  Gene Name: PRAME family member 6
  ENSP ID: ENSP00000488780

SEQ ID NO: 66206 - protein, 474 aa, Homo sapiens
  Payload ID: 13212
  Gene Symbol: PRAMEF7
  Gene Name: PRAME family member 7
  Uniprot ID: Q5VXH5
  ENSP ID: ENSP00000328915
MSIRAPPRLLELARQRLLRDQALAISTMEELPRELFPTLFMEAFSRRRCETLKTMVQAWPFTRLPLGSLMKSPHLESLKSVLEGVDVLLTQEVRPRQSKLQVLDLRNVDENFCDIFSGATASFPEALSQKQTADNCPGTGRQQPFMVFIDLCLKNRTLDECLTHLLEWGKQRKGLLHVCCKELQVFGMPIHSIIEVLNMVELDCIQEVEVCCPWELSTLVKFAPYLGQMRNLRKLVLFNIRASACIPPDNKGQFIARFTSQFLKLDYFQNLSMHSVSFLEGHLDQLLRCLQASLEMVVMTDCLLSESDLKHLSWCPSIRQLKELDLRGVTLTHFSPEPLTGLLEQAVATLQTLDLEDCGIMDSQLSAILPVLSRCSQLSTFSFCGNLISMAALENLLRHTVGLSKLSLELYPAPLESYDTQGALCWGRFAELGAELMNTLRDLRQPKIIVFCTVPCPRCGIRASYDLEPSHCLC

SEQ ID NO: 66207 - protein, 474 aa, Homo sapiens; identical to SEQ ID NO: 66206
  Payload ID: 13212
  Gene Symbol: PRAMEF7
  Gene Name: PRAME family member 7
  ENSP ID: ENSP00000347211

SEQ ID NO: 66208 - protein, 474 aa, Homo sapiens; identical to SEQ ID NO: 66206
  Payload ID: 13212
  Gene Symbol: PRAMEF7
  Gene Name: PRAME family member 7
  ENSP ID: ENSP00000484237

SEQ ID NO: 66209 - protein, 474 aa, Homo sapiens; identical to SEQ ID NO: 66206
  Payload ID: 13212
  Gene Symbol: PRAMEF7
  Gene Name: PRAME family member 7
  ENSP ID: ENSP00000488446

SEQ ID NO: 66210 - protein, 474 aa, Homo sapiens
  Payload ID: 13213
  Gene Symbol: PRAMEF8
  Gene Name: PRAME family member 8
  Uniprot ID: Q5VWM4
  ENSP ID: ENSP00000349931
MSIRAPPRLLELARQRLLRDQALAISTMEELPRELFPTLFMEAFSRRRCETLKTMVQAWPFTRLPLGSLMKSPHLESLKSVLEGVDVLLTQEVRPRQSKLQVLDLRNVDENFCDIFSGATASFPEALSQKQTADNCPGTGRQQPFMVFIDLCLKNRTLDECLTHLLEWGKQRKGLLHVCCKELQVFGMPIHSIIEVLNMVELDCIQEVEVCCPWELSTLVKFAPYLGQMRNLRKLVLFNIRASACIPPDNKGQFIARFTSQFLKLDYFQNLSMHSVSFLEGHLDQLLRCLQASLEMVVMTDCLLSESDLKHLSWCPSIRQLKELDLRGVTLTHFSPEPLTGLLEQVVATLQTLDLEDCGIMDSQLSAILPVLSRCSQLSTFSFCGNLISMAALENLLRHTVGLSKLSLELYPAPLESYDTQGALCWGRFAELGAELMNTLRDLRQPKIIVFCTVPCPRCGIRASYDLEPSHCLC

SEQ ID NO: 66211 - protein, 474 aa, Homo sapiens; identical to SEQ ID NO: 66210
  Payload ID: 13213
  Gene Symbol: PRAMEF8
  Gene Name: PRAME family member 8
  Uniprot ID: Q5VWM4
  ENSP ID: ENSP00000478860

SEQ ID NO: 66212 - protein, 474 aa, Homo sapiens; identical to SEQ ID NO: 66210
  Payload ID: 13213
  Gene Symbol: PRAMEF8
  Gene Name: PRAME family member 8
  Uniprot ID: Q5VWM4
  ENSP ID: ENSP00000480509

SEQ ID NO: 66213 - protein, 474 aa, Homo sapiens; identical to SEQ ID NO: 66210
  Payload ID: 13213
  Gene Symbol: PRAMEF8
  Gene Name: PRAME family member 8
  Uniprot ID: Q5VWM4
  ENSP ID: ENSP00000484204

SEQ ID NO: 66214 - protein, 474 aa, Homo sapiens; identical to SEQ ID NO: 66210
  Payload ID: 13213
  Gene Symbol: PRAMEF8
  Gene Name: PRAME family member 8
  Uniprot ID: Q5VWM4
  ENSP ID: ENSP00000484753

SEQ ID NO: 66215 - protein, 474 aa, Homo sapiens; identical to SEQ ID NO: 66210
  Payload ID: 13213
  Gene Symbol: PRAMEF8
  Gene Name: PRAME family member 8
  ENSP ID: ENSP00000488367

SEQ ID NO: 66216 - protein, 474 aa, Homo sapiens; identical to SEQ ID NO: 66210
  Payload ID: 13213
  Gene Symbol: PRAMEF8
  Gene Name: PRAME family member 8
  ENSP ID: ENSP00000488817

SEQ ID NO: 66217 - protein, 474 aa, Homo sapiens; identical to SEQ ID NO: 66210
  Payload ID: 13213
  Gene Symbol: PRAMEF8
  Gene Name: PRAME family member 8
  ENSP ID: ENSP00000488892

SEQ ID NO: 66218 - protein, 478 aa, Homo sapiens
  Payload ID: 13214
  Gene Symbol: PRAMEF9
  Gene Name: PRAME family member 9
  ENSP ID: ENSP00000482656
MKMSIRTPPRLLELAGRSLLRDQALAMSTLEELPTELFPPLFMEAFSRRCCEALKLMVQAWPFRRLPLRPLIKMPCLEAFQAVLDGLDALLTQGVCPRRWKLQVLDLQDVCENFWMVWSEAMARGSFLNAKRNKTPVQDCPRMRGQQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKFLTITNCVLLESDLKHLSQCPSISQLKTLDLSGIRLTNYSLVPLQILLEKVAATLEYLDLDDCGIIDSQVNAILPALSRCFELNAFSFCGNPISMATLENLLSHTIILKNLCVEVYPAPRESYGADGTLCWNRFAQIRAELMNRVRDLRHPKRIFFCIDNCPDCGNRSFYDLEADQYCC

SEQ ID NO: 66219 - protein, 478 aa, Homo sapiens
  Payload ID: 13214
  Gene Symbol: PRAMEF9
  Gene Name: PRAME family member 9
  ENSP ID: ENSP00000485258
MKMSIRTPPRLLELAGRSLLRDQALAMSTLEELPTELFPPLFMEAFSRRRCEALKLMVQAWPFRRLPLRPLIKMPCLEAFQAVLDGLDALLTQGVCPRRWKLQVLDLQDVCENFWMVWSEAMARGSFLNAKRNKTPVQDCPRMRGQQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNAFSFCGNPISMATLENLLSHTIILKNLCVEVYPAPRESYGADGTLCWSRFAQIRAELMNRVRDLRHPKRIFFCIDNCPDCGNRSFYDLEADQYCC

SEQ ID NO: 66220 - protein, 478 aa, Homo sapiens; identical to SEQ ID NO: 66219
  Payload ID: 13214
  Gene Symbol: PRAMEF9
  Gene Name: PRAME family member 9
  ENSP ID: ENSP00000488044

SEQ ID NO: 66221 - protein, 478 aa, Homo sapiens; identical to SEQ ID NO: 66165
  Payload ID: 13215
  Gene Symbol:
  Gene Name: PRAMEF9
  ENSP ID: ENSP00000488575

SEQ ID NO: 66222 - protein, 476 aa, Homo sapiens; identical to SEQ ID NO: 66166
  Payload ID: 13215
  Gene Symbol:
  Gene Name: PRAMEF9
  ENSP ID: ENSP00000488760

SEQ ID NO: 66223 - protein, 281 aa, Homo sapiens
  Payload ID: 13216
  Gene Symbol: PTCRA
  Gene Name: pre T-cell antigen receptor alpha
  Uniprot ID: Q6ISU1
  ENSP ID: ENSP00000304447
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 66224 - protein, 174 aa, Homo sapiens
  Payload ID: 13216
  Gene Symbol: PTCRA
  Gene Name: pre T-cell antigen receptor alpha
  Uniprot ID: Q6ISU1
  ENSP ID: ENSP00000392288
MAGTWLLLLLALGCPALPTGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 66225 - protein, 256 aa, Homo sapiens
  Payload ID: 13216
  Gene Symbol: PTCRA
  Gene Name: pre T-cell antigen receptor alpha
  Uniprot ID: Q6ISU1
  ENSP ID: ENSP00000409550
MAGTWLLLLLALGCPALPTGPVSFPSSPEAATTGPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 66226 - protein, 296 aa, Homo sapiens
  Payload ID: 13216
  Gene Symbol: PTCRA
  Gene Name: pre T-cell antigen receptor alpha
  ENSP ID: ENSP00000477815
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGGCGLLRAPERFLLAGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 66227 - protein, 144 aa, Homo sapiens
  Payload ID: 13217
  Gene Symbol: VPREB1
  Gene Name: pre-B lymphocyte 1
  ENSP ID: ENSP00000304590
MSAPCPGLLSCSCCLSTAQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 66228 - protein, 145 aa, Homo sapiens
  Payload ID: 13217
  Gene Symbol: VPREB1
  Gene Name: pre-B lymphocyte 1
  Uniprot ID: P12018
  ENSP ID: ENSP00000385361
MSWAPVLLMLFVYCTGCGPQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 66229 - protein, 123 aa, Homo sapiens
  Payload ID: 13218
  Gene Symbol: VPREB3
  Gene Name: pre-B lymphocyte 3
  Uniprot ID: Q9UKI3
  ENSP ID: ENSP00000248948
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 66230 - protein, 107 aa, Homo sapiens
  Payload ID: 13218
  Gene Symbol: VPREB3
  Gene Name: pre-B lymphocyte 3
  ENSP ID: ENSP00000381483
MACRCLSFLLMGTFLSGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 66231 - protein, 170 aa, Homo sapiens
  Payload ID: 13219
  Gene Symbol: PBX1
  Gene Name: pre-B-cell leukemia homeobox 1
  ENSP ID: ENSP00000341455
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQ

SEQ ID NO: 66232 - protein, 347 aa, Homo sapiens
  Payload ID: 13219
  Gene Symbol: PBX1
  Gene Name: pre-B-cell leukemia homeobox 1
  Uniprot ID: P40424
  ENSP ID: ENSP00000356872
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGGYPSPCYQPDRRIQ

SEQ ID NO: 66233 - protein, 430 aa, Homo sapiens
  Payload ID: 13219
  Gene Symbol: PBX1
  Gene Name: pre-B-cell leukemia homeobox 1
  Uniprot ID: P40424
  ENSP ID: ENSP00000405890
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 66234 - protein, 342 aa, Homo sapiens
  Payload ID: 13219
  Gene Symbol: PBX1
  Gene Name: pre-B-cell leukemia homeobox 1
  ENSP ID: ENSP00000439943
VLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 66235 - protein, 325 aa, Homo sapiens
  Payload ID: 13219
  Gene Symbol: PBX1
  Gene Name: pre-B-cell leukemia homeobox 1
  ENSP ID: ENSP00000452727
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 66236 - protein, 159 aa, Homo sapiens
  Payload ID: 13219
  Gene Symbol: PBX1
  Gene Name: pre-B-cell leukemia homeobox 1
  ENSP ID: ENSP00000452804
MKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFL

SEQ ID NO: 66237 - protein, 128 aa, Homo sapiens
  Payload ID: 13219
  Gene Symbol: PBX1
  Gene Name: pre-B-cell leukemia homeobox 1
  ENSP ID: ENSP00000453163
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDA

SEQ ID NO: 66238 - protein, 339 aa, Homo sapiens
  Payload ID: 13219
  Gene Symbol: PBX1
  Gene Name: pre-B-cell leukemia homeobox 1
  ENSP ID: ENSP00000453188
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVDTLRHVISQTGGYSDGLAASQMYSPQGISANGGWQDATTPSSVTSPTEGPGSVHSDTSN

SEQ ID NO: 66239 - protein, 97 aa, Homo sapiens
  Payload ID: 13219
  Gene Symbol: PBX1
  Gene Name: pre-B-cell leukemia homeobox 1
  ENSP ID: ENSP00000453262
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVS

SEQ ID NO: 66240 - protein, 138 aa, Homo sapiens
  Payload ID: 13219
  Gene Symbol: PBX1
  Gene Name: pre-B-cell leukemia homeobox 1
  ENSP ID: ENSP00000453331
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQ

SEQ ID NO: 66241 - protein, 70 aa, Homo sapiens
  Payload ID: 13219
  Gene Symbol: PBX1
  Gene Name: pre-B-cell leukemia homeobox 1
  ENSP ID: ENSP00000473998
MDEQPRLMHSHAGVGMAGHPGLSQHLQDGAGGTEGEGGRKQDIGDILQQIMTITDQSLDEAQASNYMAEE

SEQ ID NO: 66242 - protein, 259 aa, Homo sapiens
  Payload ID: 13219
  Gene Symbol: PBX1
  Gene Name: pre-B-cell leukemia homeobox 1
  ENSP ID: ENSP00000483563
VLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGGYPSPCYQPDRRIQ

SEQ ID NO: 66243 - protein, 420 aa, Homo sapiens
  Payload ID: 13219
  Gene Symbol: PBX1
  Gene Name: pre-B-cell leukemia homeobox 1
  Uniprot ID: P40424
  ENSP ID: ENSP00000485692
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISHLPRHPRQAHYHFRLPTWHP

SEQ ID NO: 66244 - protein, 430 aa, Homo sapiens
  Payload ID: 13220
  Gene Symbol: PBX2
  Gene Name: pre-B-cell leukemia homeobox 2
  Uniprot ID: P40425
  ENSP ID: ENSP00000364190
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 66245 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000372757

SEQ ID NO: 66246 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000390009

SEQ ID NO: 66247 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000391745

SEQ ID NO: 66248 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000397177

SEQ ID NO: 66249 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000403948

SEQ ID NO: 66250 - protein, 430 aa, Homo sapiens; identical to SEQ ID NO: 66244
  Payload ID: 13220
  Gene Symbol: PBX2
  Gene Name: pre-B-cell leukemia homeobox 2
  Uniprot ID: P40425
  ENSP ID: ENSP00000410710

SEQ ID NO: 66251 - protein, 351 aa, Homo sapiens
  Payload ID: 13221
  Gene Symbol: PBX3
  Gene Name: pre-B-cell leukemia homeobox 3
  Uniprot ID: P40426
  ENSP ID: ENSP00000341990
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 66252 - protein, 93 aa, Homo sapiens
  Payload ID: 13221
  Gene Symbol: PBX3
  Gene Name: pre-B-cell leukemia homeobox 3
  ENSP ID: ENSP00000362581
MDDQSRMLQTLAGVNLAGHSVQGGMALPPPPHGHEGADGDGRKQDIGDILHQIMTITDQSLDEAQAKKHALNCHRMKPALFSVLCEIKEKTGM

SEQ ID NO: 66253 - protein, 455 aa, Homo sapiens
  Payload ID: 13221
  Gene Symbol: PBX3
  Gene Name: pre-B-cell leukemia homeobox 3
  ENSP ID: ENSP00000362586
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQSLVKDPKERGSKGSDIQPTSVVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 66254 - protein, 434 aa, Homo sapiens
  Payload ID: 13221
  Gene Symbol: PBX3
  Gene Name: pre-B-cell leukemia homeobox 3
  Uniprot ID: P40426
  ENSP ID: ENSP00000362588
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 66255 - protein, 93 aa, Homo sapiens; identical to SEQ ID NO: 66252
  Payload ID: 13221
  Gene Symbol: PBX3
  Gene Name: pre-B-cell leukemia homeobox 3
  ENSP ID: ENSP00000362591

SEQ ID NO: 66256 - protein, 359 aa, Homo sapiens
  Payload ID: 13221
  Gene Symbol: PBX3
  Gene Name: pre-B-cell leukemia homeobox 3
  Uniprot ID: P40426
  ENSP ID: ENSP00000387456
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 66257 - protein, 176 aa, Homo sapiens
  Payload ID: 13221
  Gene Symbol: PBX3
  Gene Name: pre-B-cell leukemia homeobox 3
  ENSP ID: ENSP00000397903
  MOD_RES (1)..(1): Any amino acid
XCFLENKSGAITCLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFY

SEQ ID NO: 66258 - protein, 160 aa, Homo sapiens
  Payload ID: 13221
  Gene Symbol: PBX3
  Gene Name: pre-B-cell leukemia homeobox 3
  ENSP ID: ENSP00000475679
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDA

SEQ ID NO: 66259 - protein, 374 aa, Homo sapiens
  Payload ID: 13222
  Gene Symbol: PBX4
  Gene Name: pre-B-cell leukemia homeobox 4
  Uniprot ID: Q9BYU1
  ENSP ID: ENSP00000251203
MAAPPRPAPSPPAPRRLDTSDVLQQIMAITDQSLDEAQARKHALNCHRMKPALFSVLCEIKEKTVVSIRGIQDEDPPDAQLLRLDNMLLAEGVCRPEKRGRGGAVARAGTATPGGCPNDNSIEHSDYRAKLSQIRQIYHSELEKYEQACREFTTHVTNLLQEQSRMRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGSSGPFPLPSAGDAFLTLRTLASLQPPPGGGCLQSQAQGSWQGATPQPATASPAGDPGSINSSTSN

SEQ ID NO: 66260 - protein, 116 aa, Homo sapiens
  Payload ID: 13222
  Gene Symbol: PBX4
  Gene Name: pre-B-cell leukemia homeobox 4
  ENSP ID: ENSP00000453069
MAAPPRPAPSPPAPRRLDTSDVLQQIMAITDQSLDEAQARKHALNCHRMKPALFSVLCEIKEKTVVSIRGIQDEDPPDAQLLRLDNMLLAEGVCRPEKRGRGGAVARAGTATPGLS

SEQ ID NO: 66261 - protein, 116 aa, Homo sapiens; identical to SEQ ID NO: 66260
  Payload ID: 13222
  Gene Symbol: PBX4
  Gene Name: pre-B-cell leukemia homeobox 4
  ENSP ID: ENSP00000453348

SEQ ID NO: 66262 - protein, 315 aa, Homo sapiens
  Payload ID: 13223
  Gene Symbol: PBXIP1
  Gene Name: pre-B-cell leukemia homeobox interacting protein 1
  ENSP ID: ENSP00000357445
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGGLSESETGPMEEVERQVLPDPEVLEAVGDRQDGLREQLQAPVPPDSVPSLQNMGLLLDKLAKENQDIRLLQAQLQVGTGRRGWARVTHLGQASVLASSPKRNVSYLPTHPDPPLSHYSQGVFPVLGSHPLC

SEQ ID NO: 66263 - protein, 731 aa, Homo sapiens
  Payload ID: 13223
  Gene Symbol: PBXIP1
  Gene Name: pre-B-cell leukemia homeobox interacting protein 1
  Uniprot ID: Q96AQ6
  ENSP ID: ENSP00000357448
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 66264 - protein, 702 aa, Homo sapiens
  Payload ID: 13223
  Gene Symbol: PBXIP1
  Gene Name: pre-B-cell leukemia homeobox interacting protein 1
  Uniprot ID: Q96AQ6
  ENSP ID: ENSP00000357450
MDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 66265 - protein, 147 aa, Homo sapiens
  Payload ID: 13223
  Gene Symbol: PBXIP1
  Gene Name: pre-B-cell leukemia homeobox interacting protein 1
  ENSP ID: ENSP00000432543
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAVTSLPCPCPFP

SEQ ID NO: 66266 - protein, 509 aa, Homo sapiens
  Payload ID: 13224
  Gene Symbol: PRAME
  Gene Name: preferentially expressed antigen in melanoma
  Uniprot ID: P78395
  ENSP ID: ENSP00000381726
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 66267 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000381728

SEQ ID NO: 66268 - protein, 115 aa, Homo sapiens
  Payload ID: 13224
  Gene Symbol: PRAME
  Gene Name: preferentially expressed antigen in melanoma
  ENSP ID: ENSP00000384058
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPR

SEQ ID NO: 66269 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000384343

SEQ ID NO: 66270 - protein, 86 aa, Homo sapiens
  Payload ID: 13224
  Gene Symbol: PRAME
  Gene Name: preferentially expressed antigen in melanoma
  ENSP ID: ENSP00000385091
MERRRLWGSIQSRYISMSVWTSPRRLVELAGQSLLKDEALAIAALELLPRELFPPLFMAAFDGRHSQTLKAMVQAWPFTCLPLGVL

SEQ ID NO: 66271 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000385198

SEQ ID NO: 66272 - protein, 64 aa, Homo sapiens
  Payload ID: 13224
  Gene Symbol: PRAME
  Gene Name: preferentially expressed antigen in melanoma
  ENSP ID: ENSP00000399816
MERRRLWRGVERGGMPRKACNSFRGARGGTQRPWSQCCGLPRGLGRWLLHHSWVWVPFRADTSA

SEQ ID NO: 66273 - protein, 189 aa, Homo sapiens
  Payload ID: 13224
  Gene Symbol: PRAME
  Gene Name: preferentially expressed antigen in melanoma
  ENSP ID: ENSP00000407121
  MOD_RES (1)..(1): Any amino acid
XDAKAHTSSGVREYELQEALISLPHGLGPLGGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLS

SEQ ID NO: 66274 - protein, 201 aa, Homo sapiens
  Payload ID: 13224
  Gene Symbol: PRAME
  Gene Name: preferentially expressed antigen in melanoma
  ENSP ID: ENSP00000407320
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKR

SEQ ID NO: 66275 - protein, 152 aa, Homo sapiens
  Payload ID: 13224
  Gene Symbol: PRAME
  Gene Name: preferentially expressed antigen in melanoma
  ENSP ID: ENSP00000412318
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAA

SEQ ID NO: 66276 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000445097

SEQ ID NO: 66277 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000445675

SEQ ID NO: 66278 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000484066

SEQ ID NO: 66279 - protein, 201 aa, Homo sapiens; identical to SEQ ID NO: 66274
  Payload ID: 13224
  Gene Symbol: PRAME
  Gene Name: preferentially expressed antigen in melanoma
  ENSP ID: ENSP00000485726

SEQ ID NO: 66280 - protein, 86 aa, Homo sapiens; identical to SEQ ID NO: 66270
  Payload ID: 13224
  Gene Symbol: PRAME
  Gene Name: preferentially expressed antigen in melanoma
  ENSP ID: ENSP00000486222

SEQ ID NO: 66281 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000486330

SEQ ID NO: 66282 - protein, 509 aa, Homo sapiens; identical to SEQ ID NO: 66266
  Payload ID: 13224
  Gene Symbol: PRAME
  Gene Name: preferentially expressed antigen in melanoma
  Uniprot ID: P78395
  ENSP ID: ENSP00000486485

SEQ ID NO: 66283 - protein, 152 aa, Homo sapiens; identical to SEQ ID NO: 66275
  Payload ID: 13224
  Gene Symbol: PRAME
  Gene Name: preferentially expressed antigen in melanoma
  ENSP ID: ENSP00000486910

SEQ ID NO: 66284 - protein, 149 aa, Homo sapiens
  Payload ID: 13224
  Gene Symbol: PRAME
  Gene Name: preferentially expressed antigen in melanoma
  ENSP ID: ENSP00000487167
MSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLS

SEQ ID NO: 66285 - protein, 114 aa, Homo sapiens
  Payload ID: 13224
  Gene Symbol: PRAME
  Gene Name: preferentially expressed antigen in melanoma
  ENSP ID: ENSP00000487168
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRP

SEQ ID NO: 66286 - protein, 122 aa, Homo sapiens
  Payload ID: 13225
  Gene Symbol: PFDN1
  Gene Name: prefoldin subunit 1
  Uniprot ID: O60925
  ENSP ID: ENSP00000261813
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 66287 - protein, 35 aa, Homo sapiens
  Payload ID: 13225
  Gene Symbol: PFDN1
  Gene Name: prefoldin subunit 1
  ENSP ID: ENSP00000426383
MAAPVDLELKKVYSSVQGSNSQSAVREAENSRRKN

SEQ ID NO: 66288 - protein, 117 aa, Homo sapiens
  Payload ID: 13225
  Gene Symbol: PFDN1
  Gene Name: prefoldin subunit 1
  ENSP ID: ENSP00000428707
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEVTEPFLSWGMGLALFSFPFLYL

SEQ ID NO: 66289 - protein, 154 aa, Homo sapiens
  Payload ID: 13226
  Gene Symbol: PFDN2
  Gene Name: prefoldin subunit 2
  Uniprot ID: Q9UHV9
  ENSP ID: ENSP00000356989
MAENSGRAGKSSGSGAGKGAVSAEQVIAGFNRLRQEQRGLASKAAELEMELNEHSLVIDTLKEVDETRKCYRMVGGVLVERTVKEVLPALENNKEQIQKIIETLTQQLQAKGKELNEFREKHNIRLMGEDEKPAAKENSEGAGAKASSAGVLVS

SEQ ID NO: 66290 - protein, 134 aa, Homo sapiens
  Payload ID: 13227
  Gene Symbol: PFDN4
  Gene Name: prefoldin subunit 4
  Uniprot ID: Q9NQP4
  ENSP ID: ENSP00000360473
MAATMKKAAAEDVNVTFEDQQKINKFARNTSRITELKEEIEVKKKQLQNLEDACDDIMLADDDCLMIPYQIGDVFISHSQEETQEMLEEAKKNLQEEIDALESRVESIQRVLADLKVQLYAKFGSNINLEADES

SEQ ID NO: 66291 - protein, 136 aa, Homo sapiens
  Payload ID: 13227
  Gene Symbol: PFDN4
  Gene Name: prefoldin subunit 4
  ENSP ID: ENSP00000432441
MAATMKKAAAEDVNVTFEDQQKINKFARNTSRITELKEEIEVKKKQLQNLEDACDDIMLADDDCLMIPYQIGDVFISHSQEETQEMLEEAKKNLQEEIDALESRVESIQRVLADLKVQLYAKFGSNINLEADERNT

SEQ ID NO: 66292 - protein, 66 aa, Homo sapiens
  Payload ID: 13228
  Gene Symbol: PFDN5
  Gene Name: prefoldin subunit 5
  Uniprot ID: Q99471
  ENSP ID: ENSP00000243040
MAQSINITELNLPQLEMLKNQLDQEVEFLSTSIAQLKVVQTKYVEAKDCLNVLNKSNEDVCPWEAA

SEQ ID NO: 66293 - protein, 109 aa, Homo sapiens
  Payload ID: 13228
  Gene Symbol: PFDN5
  Gene Name: prefoldin subunit 5
  Uniprot ID: Q99471
  ENSP ID: ENSP00000266964
MAQSINITELNLPQLEMLKNQLDQMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 66294 - protein, 154 aa, Homo sapiens
  Payload ID: 13228
  Gene Symbol: PFDN5
  Gene Name: prefoldin subunit 5
  Uniprot ID: Q99471
  ENSP ID: ENSP00000334188
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 66295 - protein, 154 aa, Homo sapiens; identical to SEQ ID NO: 66294
  Payload ID: 13228
  Gene Symbol: PFDN5
  Gene Name: prefoldin subunit 5
  Uniprot ID: Q99471
  ENSP ID: ENSP00000447942

SEQ ID NO: 66296 - protein, 29 aa, Homo sapiens
  Payload ID: 13228
  Gene Symbol: PFDN5
  Gene Name: prefoldin subunit 5
  ENSP ID: ENSP00000449388
MAQSINITELNLPQLEMLKNQLDQAGAQW

SEQ ID NO: 66297 - protein, 37 aa, Homo sapiens
  Payload ID: 13228
  Gene Symbol: PFDN5
  Gene Name: prefoldin subunit 5
  ENSP ID: ENSP00000450068
MAQSINITELNLPQLEMLKNQLDQTEFRSVAQAGAQW

SEQ ID NO: 66298 - protein, 29 aa, Homo sapiens
  Payload ID: 13228
  Gene Symbol: PFDN5
  Gene Name: prefoldin subunit 5
  ENSP ID: ENSP00000450380
MAQSINITELNLPQLEMLKNQLDQAGAQW

SEQ ID NO: 66299 - protein, 84 aa, Homo sapiens
  Payload ID: 13228
  Gene Symbol: PFDN5
  Gene Name: prefoldin subunit 5
  ENSP ID: ENSP00000454489
MAQSINITELNLPQLEMLKNQLDQTAEDAKDFFKRKIDFLTKQMEKIQPALQEKHAMKQAVMEMMSQKIQQLTALGAAQATAKA

SEQ ID NO: 66300 - protein, 152 aa, Homo sapiens
  Payload ID: 13228
  Gene Symbol: PFDN5
  Gene Name: prefoldin subunit 5
  ENSP ID: ENSP00000455296
  MOD_RES (1)..(1): Any amino acid
XNITELNLPQLEMLKNQLDQEVEFLSTSIAQLKVVQTKYVEAKDCLNVLNKSNEDGISLCRPGWSAMMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 66301 - protein, 37 aa, Homo sapiens; identical to SEQ ID NO: 66297
  Payload ID: 13228
  Gene Symbol: PFDN5
  Gene Name: prefoldin subunit 5
  ENSP ID: ENSP00000486843

SEQ ID NO: 66302 - protein, 129 aa, Homo sapiens
  Payload ID: 13229
  Gene Symbol: PFDN6
  Gene Name: prefoldin subunit 6
  Uniprot ID: O15212
  ENSP ID: ENSP00000363734
MAELIQKKLQGEVEKYQQLQKDLSKSMSGRQKLEAQLTENNIVKEELALLDGSNVVFKLLGPVLVKQELGEARATVGKRLDYITAEIKRYESQLRDLERQSEQQRETLAQLQQEFQRAQAAKAGAPGKA

SEQ ID NO: 66303 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000363735

SEQ ID NO: 66304 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000363738

SEQ ID NO: 66305 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000372694

SEQ ID NO: 66306 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000378563

SEQ ID NO: 66307 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000382314

SEQ ID NO: 66308 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000382316

SEQ ID NO: 66309 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000395462

SEQ ID NO: 66310 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000398171

SEQ ID NO: 66311 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000400152

SEQ ID NO: 66312 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000402212

SEQ ID NO: 66313 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000402553

SEQ ID NO: 66314 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000403771

SEQ ID NO: 66315 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000404773

SEQ ID NO: 66316 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000412319

SEQ ID NO: 66317 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000415678

SEQ ID NO: 66318 - protein, 103 aa, Homo sapiens
  Payload ID: 13229
  Gene Symbol: PFDN6
  Gene Name: prefoldin subunit 6
  ENSP ID: ENSP00000418433
MAELIQKKLQGEVEKYQQLQKDLSKSMSGRQKLEAQLTENNIVKEELALLDGSNVVFKLLGPVLVKQELGEARATVGKRLDYITAEIFLRTIPDPGDVPDSFF

SEQ ID NO: 66319 - protein, 103 aa, Homo sapiens; identical to SEQ ID NO: 66318
  Payload ID: 13229
  Gene Symbol: PFDN6
  Gene Name: prefoldin subunit 6
  ENSP ID: ENSP00000419277

SEQ ID NO: 66320 - protein, 103 aa, Homo sapiens; identical to SEQ ID NO: 66318
  Payload ID: 13229
  Gene Symbol: PFDN6
  Gene Name: prefoldin subunit 6
  ENSP ID: ENSP00000419351

SEQ ID NO: 66321 - protein, 103 aa, Homo sapiens; identical to SEQ ID NO: 66318
  Payload ID: 13229
  Gene Symbol: PFDN6
  Gene Name: prefoldin subunit 6
  ENSP ID: ENSP00000420135

SEQ ID NO: 66322 - protein, 103 aa, Homo sapiens; identical to SEQ ID NO: 66318
  Payload ID: 13229
  Gene Symbol: PFDN6
  Gene Name: prefoldin subunit 6
  ENSP ID: ENSP00000420209

SEQ ID NO: 66323 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000447540

SEQ ID NO: 66324 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000448607

SEQ ID NO: 66325 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000448784

SEQ ID NO: 66326 - protein, 129 aa, Homo sapiens; identical to SEQ ID NO: 66302
  Payload ID: 13229
  Gene Symbol: PFDN6
  Gene Name: prefoldin subunit 6
  Uniprot ID: O15212
  ENSP ID: ENSP00000449925

SEQ ID NO: 66327 - protein, 426 aa, Homo sapiens
  Payload ID: 13230
  Gene Symbol: PSG1
  Gene Name: pregnancy specific beta-1-glycoprotein 1
  Uniprot ID: P11464
  ENSP ID: ENSP00000244296
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSGKWIPASLAIGF

SEQ ID NO: 66328 - protein, 428 aa, Homo sapiens
  Payload ID: 13230
  Gene Symbol: PSG1
  Gene Name: pregnancy specific beta-1-glycoprotein 1
  Uniprot ID: P11464
  ENSP ID: ENSP00000308970
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSAYSSSINYTSGNRN

SEQ ID NO: 66329 - protein, 326 aa, Homo sapiens
  Payload ID: 13230
  Gene Symbol: PSG1
  Gene Name: pregnancy specific beta-1-glycoprotein 1
  ENSP ID: ENSP00000385386
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 66330 - protein, 419 aa, Homo sapiens
  Payload ID: 13230
  Gene Symbol: PSG1
  Gene Name: pregnancy specific beta-1-glycoprotein 1
  Uniprot ID: P11464
  ENSP ID: ENSP00000413041
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 66331 - protein, 154 aa, Homo sapiens
  Payload ID: 13230
  Gene Symbol: PSG1
  Gene Name: pregnancy specific beta-1-glycoprotein 1
  ENSP ID: ENSP00000469575
MRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSA

SEQ ID NO: 66332 - protein, 242 aa, Homo sapiens
  Payload ID: 13230
  Gene Symbol: PSG1
  Gene Name: pregnancy specific beta-1-glycoprotein 1
  ENSP ID: ENSP00000470690
  MOD_RES (1)..(1): Any amino acid
XSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLHGPDLPRIYPSFTYYRSGEVLYLSCSADSNPPAQYSWTINEKFQLPGQKLFIRHITTKHSGLYVCSVRNSATGKESSKSMTVEVS

SEQ ID NO: 66333 - protein, 324 aa, Homo sapiens
  Payload ID: 13230
  Gene Symbol: PSG1
  Gene Name: pregnancy specific beta-1-glycoprotein 1
  ENSP ID: ENSP00000472284
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 66334 - protein, 417 aa, Homo sapiens
  Payload ID: 13230
  Gene Symbol: PSG1
  Gene Name: pregnancy specific beta-1-glycoprotein 1
  Uniprot ID: P11464
  ENSP ID: ENSP00000472610
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 66335 - protein, 213 aa, Homo sapiens
  Payload ID: 13231
  Gene Symbol: PSG11
  Gene Name: pregnancy specific beta-1-glycoprotein 11
  Uniprot ID: Q9UQ72
  ENSP ID: ENSP00000304913
MGPLSAPPCTEHIKWKGLLLTVETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 66336 - protein, 335 aa, Homo sapiens
  Payload ID: 13231
  Gene Symbol: PSG11
  Gene Name: pregnancy specific beta-1-glycoprotein 11
  Uniprot ID: Q9UQ72
  ENSP ID: ENSP00000319140
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 66337 - protein, 213 aa, Homo sapiens; identical to SEQ ID NO: 66335
  Payload ID: 13231
  Gene Symbol: PSG11
  Gene Name: pregnancy specific beta-1-glycoprotein 11
  Uniprot ID: Q9UQ72
  ENSP ID: ENSP00000385427

SEQ ID NO: 66338 - protein, 320 aa, Homo sapiens
  Payload ID: 13231
  Gene Symbol: PSG11
  Gene Name: pregnancy specific beta-1-glycoprotein 11
  ENSP ID: ENSP00000472372
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYPKLPMPYITINNLNPRENKDVLTFTCEPKSENYAYIWWLNCQSLPVSPRVKRPIENRILILPSVTRNETGPYQCEIRDRYGGIRSDSVTLNVLYGPDLPRIFPSVTSYYSGENLDLSCFANSNPPAQYSWTINGKFQLSGQKLFIPQITPKHNGLYACSARNSATGEESSTSLTIRV

SEQ ID NO: 66339 - protein, 126 aa, Homo sapiens
  Payload ID: 13231
  Gene Symbol: PSG11
  Gene Name: pregnancy specific beta-1-glycoprotein 11
  ENSP ID: ENSP00000472717
MIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYRHSLDSALSLEVTGSSQSL

SEQ ID NO: 66340 - protein, 117 aa, Homo sapiens
  Payload ID: 13232
  Gene Symbol: PSG2
  Gene Name: pregnancy specific beta-1-glycoprotein 2
  ENSP ID: ENSP00000332984
  MOD_RES (1)..(1): Any amino acid
XRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 66341 - protein, 335 aa, Homo sapiens
  Payload ID: 13232
  Gene Symbol: PSG2
  Gene Name: pregnancy specific beta-1-glycoprotein 2
  Uniprot ID: P11465
  ENSP ID: ENSP00000385706
MGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 66342 - protein, 428 aa, Homo sapiens
  Payload ID: 13233
  Gene Symbol: PSG3
  Gene Name: pregnancy specific beta-1-glycoprotein 3
  Uniprot ID: Q16557
  ENSP ID: ENSP00000332215
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 66343 - protein, 475 aa, Homo sapiens
  Payload ID: 13233
  Gene Symbol: PSG3
  Gene Name: pregnancy specific beta-1-glycoprotein 3
  ENSP ID: ENSP00000468936
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSDSCFHSSSKYLPSATVQNCFLFKEIYEKTLTRTLEYKFLITSRSYHWTKNFQNFNEQADTS

SEQ ID NO: 66344 - protein, 91 aa, Homo sapiens
  Payload ID: 13233
  Gene Symbol: PSG3
  Gene Name: pregnancy specific beta-1-glycoprotein 3
  ENSP ID: ENSP00000469292
MKDLYHYITSYVVDGQIIIYGPAYSGRETVYSNASLLIQNVTREDAGSYTLHIVKRGDGTRGETGHFTFTLYRHSLDSALSLEVTGSSQPL

SEQ ID NO: 66345 - protein, 428 aa, Homo sapiens; identical to SEQ ID NO: 66342
  Payload ID: 13233
  Gene Symbol: PSG3
  Gene Name: pregnancy specific beta-1-glycoprotein 3
  Uniprot ID: Q16557
  ENSP ID: ENSP00000480223

SEQ ID NO: 66346 - protein, 326 aa, Homo sapiens
  Payload ID: 13234
  Gene Symbol: PSG4
  Gene Name: pregnancy specific beta-1-glycoprotein 4
  Uniprot ID: Q00888
  ENSP ID: ENSP00000244295
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 66347 - protein, 419 aa, Homo sapiens
  Payload ID: 13234
  Gene Symbol: PSG4
  Gene Name: pregnancy specific beta-1-glycoprotein 4
  Uniprot ID: Q00888
  ENSP ID: ENSP00000384770
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 66348 - protein, 326 aa, Homo sapiens
  Payload ID: 13234
  Gene Symbol: PSG4
  Gene Name: pregnancy specific beta-1-glycoprotein 4
  Uniprot ID: Q00888
  ENSP ID: ENSP00000387864
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 66349 - protein, 252 aa, Homo sapiens
  Payload ID: 13234
  Gene Symbol: PSG4
  Gene Name: pregnancy specific beta-1-glycoprotein 4
  ENSP ID: ENSP00000388134
MKHCPQQETSTIGGKKKHPEGGDPENSHIYRSLPPVPASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLL

SEQ ID NO: 66350 - protein, 244 aa, Homo sapiens
  Payload ID: 13234
  Gene Symbol: PSG4
  Gene Name: pregnancy specific beta-1-glycoprotein 4
  ENSP ID: ENSP00000469547
  MOD_RES (1)..(1): Any amino acid
XSLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAES

SEQ ID NO: 66351 - protein, 78 aa, Homo sapiens
  Payload ID: 13234
  Gene Symbol: PSG4
  Gene Name: pregnancy specific beta-1-glycoprotein 4
  ENSP ID: ENSP00000470073
MTYLYHYITSYVVDGQRIIYGPAYSGRERVYSNASLLIQNVTQEDAGSYTLHIIKRRDGTGGVTGHFTFTLHLETPKP

SEQ ID NO: 66352 - protein, 52 aa, Homo sapiens
  Payload ID: 13234
  Gene Symbol: PSG4
  Gene Name: pregnancy specific beta-1-glycoprotein 4
  ENSP ID: ENSP00000470992
MGPLSAPPCTQRITWKGVLLTGCSCPKPTGPSLYLVSQSILQDPMNVKYGTQ

SEQ ID NO: 66353 - protein, 292 aa, Homo sapiens
  Payload ID: 13234
  Gene Symbol: PSG4
  Gene Name: pregnancy specific beta-1-glycoprotein 4
  ENSP ID: ENSP00000471124
MGPLSAPPCTQRITWKGVLLTVETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVS

SEQ ID NO: 66354 - protein, 40 aa, Homo sapiens
  Payload ID: 13234
  Gene Symbol: PSG4
  Gene Name: pregnancy specific beta-1-glycoprotein 4
  ENSP ID: ENSP00000472243
MGPLSAPPCTQRITWKGVLLTGHSLDSALSLEVTGSSQSP

SEQ ID NO: 66355 - protein, 258 aa, Homo sapiens
  Payload ID: 13234
  Gene Symbol: PSG4
  Gene Name: pregnancy specific beta-1-glycoprotein 4
  ENSP ID: ENSP00000472423
  MOD_RES (1)..(1): Any amino acid
XYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSGHISNHWLYYQGFDWDVIFKNIDRMNQYELQAKSEVSLGLASYSQGFCKSLI

SEQ ID NO: 66356 - protein, 96 aa, Homo sapiens
  Payload ID: 13234
  Gene Symbol: PSG4
  Gene Name: pregnancy specific beta-1-glycoprotein 4
  ENSP ID: ENSP00000472818
  MOD_RES (1)..(1): Any amino acid
XETPKPSISSSNLNPREAMEAVILTCDPATPAASYQWWMNGQSLPMTHRLQLSKTNRTLFIFGVTKYIAGPYECEIRNPVSASRSDPVTLNLLRSY

SEQ ID NO: 66357 - protein, 180 aa, Homo sapiens
  Payload ID: 13234
  Gene Symbol: PSG4
  Gene Name: pregnancy specific beta-1-glycoprotein 4
  ENSP ID: ENSP00000472885
MGPLSAPPCTQRITWKGVLLTVETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACS

SEQ ID NO: 66358 - protein, 335 aa, Homo sapiens
  Payload ID: 13235
  Gene Symbol: PSG5
  Gene Name: pregnancy specific beta-1-glycoprotein 5
  Uniprot ID: Q15238
  ENSP ID: ENSP00000344413
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 66359 - protein, 335 aa, Homo sapiens; identical to SEQ ID NO: 66358
  Payload ID: 13235
  Gene Symbol: PSG5
  Gene Name: pregnancy specific beta-1-glycoprotein 5
  Uniprot ID: Q15238
  ENSP ID: ENSP00000382334

SEQ ID NO: 66360 - protein, 333 aa, Homo sapiens
  Payload ID: 13235
  Gene Symbol: PSG5
  Gene Name: pregnancy specific beta-1-glycoprotein 5
  ENSP ID: ENSP00000385250
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSGKWIPASLAIGF

SEQ ID NO: 66361 - protein, 335 aa, Homo sapiens; identical to SEQ ID NO: 66358
  Payload ID: 13235
  Gene Symbol: PSG5
  Gene Name: pregnancy specific beta-1-glycoprotein 5
  Uniprot ID: Q15238
  ENSP ID: ENSP00000386008

SEQ ID NO: 66362 - protein, 157 aa, Homo sapiens
  Payload ID: 13235
  Gene Symbol: PSG5
  Gene Name: pregnancy specific beta-1-glycoprotein 5
  ENSP ID: ENSP00000386053
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYPPSGIGRLPLLNPI

SEQ ID NO: 66363 - protein, 428 aa, Homo sapiens
  Payload ID: 13235
  Gene Symbol: PSG5
  Gene Name: pregnancy specific beta-1-glycoprotein 5
  ENSP ID: ENSP00000471866
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLETPKPSISSSNLNPREAMEAVILTCDPAASDTSYLWWMNGQSLPMTHRLQLSKTNRTLFIFGVTKYIAGPYECEIRNPVSASHSDPVTLNLLLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 66364 - protein, 424 aa, Homo sapiens
  Payload ID: 13236
  Gene Symbol: PSG6
  Gene Name: pregnancy specific beta-1-glycoprotein 6
  Uniprot ID: Q00889
  ENSP ID: ENSP00000187910
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 66365 - protein, 435 aa, Homo sapiens
  Payload ID: 13236
  Gene Symbol: PSG6
  Gene Name: pregnancy specific beta-1-glycoprotein 6
  Uniprot ID: Q00889
  ENSP ID: ENSP00000292125
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSETASPQVTYAGPNTWFQEILLL

SEQ ID NO: 66366 - protein, 331 aa, Homo sapiens
  Payload ID: 13236
  Gene Symbol: PSG6
  Gene Name: pregnancy specific beta-1-glycoprotein 6
  ENSP ID: ENSP00000385736
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLHGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 66367 - protein, 73 aa, Homo sapiens
  Payload ID: 13236
  Gene Symbol: PSG6
  Gene Name: pregnancy specific beta-1-glycoprotein 6
  ENSP ID: ENSP00000469423
MTDLYHYITSYVVHGQIIYGPAYSGRETVYSNASLLIQNVTQEDAGSYTLHIIKRGDGTGGVTGYFTVTLYCE

SEQ ID NO: 66368 - protein, 157 aa, Homo sapiens
  Payload ID: 13236
  Gene Symbol: PSG6
  Gene Name: pregnancy specific beta-1-glycoprotein 6
  ENSP ID: ENSP00000470412
MGPLSAPPCTQHITWKGLLLTAETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQS

SEQ ID NO: 66369 - protein, 81 aa, Homo sapiens
  Payload ID: 13236
  Gene Symbol: PSG6
  Gene Name: pregnancy specific beta-1-glycoprotein 6
  ENSP ID: ENSP00000472935
  MOD_RES (1)..(1): Any amino acid
XEAVRLICDPETPDASYLWLLNGQNLPMTHRLQLSKTNRTLYLFGVTKYIAGPYECEIRNPVSASRSDPVTLNLLRGRCQL

SEQ ID NO: 66370 - protein, 419 aa, Homo sapiens
  Payload ID: 13237
  Gene Symbol: PSG7
  Gene Name: pregnancy specific beta-1-glycoprotein 7 (gene/pseudogene)
  ENSP ID: ENSP00000421986
MGPLSAPPCTQHITWKGLLLTASLLNFWNPPTTAQVTIEAQPPKVSEGKDVLLLVHNLPQNLTGYIWYKGQIRDLYHYVTSYIVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 66371 - protein, 426 aa, Homo sapiens
  Payload ID: 13237
  Gene Symbol: PSG7
  Gene Name: pregnancy specific beta-1-glycoprotein 7 (gene/pseudogene)
  ENSP ID: ENSP00000470856
MGPLSAPPCTQHITWKGLLLTASLLNFWNPPTTAQVTIEAQPPKVSEGKDVLLLVHNLPQNLTGYIWYKGQIRDLYHYVTSYIVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSGKWIPASLAIGF

SEQ ID NO: 66372 - protein, 419 aa, Homo sapiens
  Payload ID: 13237
  Gene Symbol: PSG7
  Gene Name: pregnancy specific beta-1-glycoprotein 7 (gene/pseudogene)
  ENSP ID: ENSP00000478484
MGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 66373 - protein, 426 aa, Homo sapiens
  Payload ID: 13237
  Gene Symbol: PSG7
  Gene Name: pregnancy specific beta-1-glycoprotein 7 (gene/pseudogene)
  ENSP ID: ENSP00000480429
MGPLSAPPCTQHITWKGLLLTASLLNFWNPPTTAQVTIEAQPPKVSEGKDVLLLVHNLPQNLTGYIWYKGQIRDLYHYVTSYIVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 66374 - protein, 297 aa, Homo sapiens
  Payload ID: 13237
  Gene Symbol: PSG7
  Gene Name: pregnancy specific beta-1-glycoprotein 7 (gene/pseudogene)
  ENSP ID: ENSP00000485117
MGPLSAPPCTQHITWKGLLLTVETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 66375 - protein, 426 aa, Homo sapiens
  Payload ID: 13238
  Gene Symbol: PSG8
  Gene Name: pregnancy specific beta-1-glycoprotein 8
  Uniprot ID: Q9UQ74
  ENSP ID: ENSP00000305005
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 66376 - protein, 297 aa, Homo sapiens
  Payload ID: 13238
  Gene Symbol: PSG8
  Gene Name: pregnancy specific beta-1-glycoprotein 8
  Uniprot ID: Q9UQ74
  ENSP ID: ENSP00000385081
MGLLSAPPCTQRITWKGLLLTVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 66377 - protein, 419 aa, Homo sapiens
  Payload ID: 13238
  Gene Symbol: PSG8
  Gene Name: pregnancy specific beta-1-glycoprotein 8
  Uniprot ID: Q9UQ74
  ENSP ID: ENSP00000385869
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 66378 - protein, 326 aa, Homo sapiens
  Payload ID: 13238
  Gene Symbol: PSG8
  Gene Name: pregnancy specific beta-1-glycoprotein 8
  ENSP ID: ENSP00000386090
MGPLSAPPCTQHIKWKGVLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 66379 - protein, 40 aa, Homo sapiens
  Payload ID: 13238
  Gene Symbol: PSG8
  Gene Name: pregnancy specific beta-1-glycoprotein 8
  ENSP ID: ENSP00000469979
MGLLSAPPCTQRITWKGLLLTGHSLDSALSLEVTGSSQPL

SEQ ID NO: 66380 - protein, 402 aa, Homo sapiens
  Payload ID: 13239
  Gene Symbol: PSG9
  Gene Name: pregnancy specific beta-1-glycoprotein 9
  Uniprot ID: Q00887
  ENSP ID: ENSP00000244293
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 66381 - protein, 426 aa, Homo sapiens
  Payload ID: 13239
  Gene Symbol: PSG9
  Gene Name: pregnancy specific beta-1-glycoprotein 9
  Uniprot ID: Q00887
  ENSP ID: ENSP00000270077
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 66382 - protein, 240 aa, Homo sapiens
  Payload ID: 13239
  Gene Symbol: PSG9
  Gene Name: pregnancy specific beta-1-glycoprotein 9
  ENSP ID: ENSP00000291752
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 66383 - protein, 333 aa, Homo sapiens
  Payload ID: 13239
  Gene Symbol: PSG9
  Gene Name: pregnancy specific beta-1-glycoprotein 9
  ENSP ID: ENSP00000396753
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYSKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 66384 - protein, 326 aa, Homo sapiens
  Payload ID: 13239
  Gene Symbol: PSG9
  Gene Name: pregnancy specific beta-1-glycoprotein 9
  ENSP ID: ENSP00000400484
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYSKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSDWILP

SEQ ID NO: 66385 - protein, 309 aa, Homo sapiens
  Payload ID: 13239
  Gene Symbol: PSG9
  Gene Name: pregnancy specific beta-1-glycoprotein 9
  ENSP ID: ENSP00000471174
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 66386 - protein, 333 aa, Homo sapiens
  Payload ID: 13239
  Gene Symbol: PSG9
  Gene Name: pregnancy specific beta-1-glycoprotein 9
  ENSP ID: ENSP00000471453
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 66387 - protein, 419 aa, Homo sapiens
  Payload ID: 13239
  Gene Symbol: PSG9
  Gene Name: pregnancy specific beta-1-glycoprotein 9
  ENSP ID: ENSP00000481887
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSDWILP

SEQ ID NO: 66388 - protein, 343 aa, Homo sapiens
  Payload ID: 13240
  Gene Symbol: PNCK
  Gene Name: pregnancy up-regulated nonubiquitous CaM kinase
  Uniprot ID: Q6P2M8
  ENSP ID: ENSP00000340586
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 66389 - protein, 366 aa, Homo sapiens
  Payload ID: 13240
  Gene Symbol: PNCK
  Gene Name: pregnancy up-regulated nonubiquitous CaM kinase
  Uniprot ID: Q6P2M8
  ENSP ID: ENSP00000359161
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYAEPVTLSGMAACVPVRASVCLWPPAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 66390 - protein, 360 aa, Homo sapiens
  Payload ID: 13240
  Gene Symbol: PNCK
  Gene Name: pregnancy up-regulated nonubiquitous CaM kinase
  Uniprot ID: Q6P2M8
  ENSP ID: ENSP00000359164
MWRRVCGGLAGRRPSGDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 66391 - protein, 343 aa, Homo sapiens; identical to SEQ ID NO: 66388
  Payload ID: 13240
  Gene Symbol: PNCK
  Gene Name: pregnancy up-regulated nonubiquitous CaM kinase
  Uniprot ID: Q6P2M8
  ENSP ID: ENSP00000359169

SEQ ID NO: 66392 - protein, 81 aa, Homo sapiens
  Payload ID: 13240
  Gene Symbol: PNCK
  Gene Name: pregnancy up-regulated nonubiquitous CaM kinase
  ENSP ID: ENSP00000390812
  MOD_RES (1)..(1): Any amino acid
XISGDTAFDRDILGSVSEQIRKNFARTHWKRAFNATSFLRHIRKLGQIPEGEGASEQGMARHSHSGGPQGLSFLHGCCVLR

SEQ ID NO: 66393 - protein, 82 aa, Homo sapiens
  Payload ID: 13240
  Gene Symbol: PNCK
  Gene Name: pregnancy up-regulated nonubiquitous CaM kinase
  ENSP ID: ENSP00000391264
MLLLKKHTEDISSVYEIRERLGSSGAPHTSWPSSASPRRPSGARRPWWRTRSQCSVGSVTPTSSLWRMSTRALPTSTWPWNW

SEQ ID NO: 66394 - protein, 224 aa, Homo sapiens
  Payload ID: 13240
  Gene Symbol: PNCK
  Gene Name: pregnancy up-regulated nonubiquitous CaM kinase
  ENSP ID: ENSP00000391772
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQI

SEQ ID NO: 66395 - protein, 42 aa, Homo sapiens
  Payload ID: 13240
  Gene Symbol: PNCK
  Gene Name: pregnancy up-regulated nonubiquitous CaM kinase
  ENSP ID: ENSP00000395360
MLLLKKHTEDISSVYEIRERLGSGAFSEVVLAQERGSAHLVA

SEQ ID NO: 66396 - protein, 86 aa, Homo sapiens
  Payload ID: 13240
  Gene Symbol: PNCK
  Gene Name: pregnancy up-regulated nonubiquitous CaM kinase
  ENSP ID: ENSP00000396128
MLLLKKHTEDISSVYEIRERLGSGAFSEVVLAQERGSAHLVALKCIPKKALRGKEALVENEIAVLRRISHPNIVALEDVHESPSHL

SEQ ID NO: 66397 - protein, 99 aa, Homo sapiens
  Payload ID: 13240
  Gene Symbol: PNCK
  Gene Name: pregnancy up-regulated nonubiquitous CaM kinase
  ENSP ID: ENSP00000397085
MLLLKKHTEDISSVYEIRERLGSGAFSEVVLAQERGSAHLVALKCIPKKALRGKEALVENEIAVLRRRFLAIAGSVTPTSSLWRMSTRALPTSTWPWNW

SEQ ID NO: 66398 - protein, 42 aa, Homo sapiens; identical to SEQ ID NO: 66395
  Payload ID: 13240
  Gene Symbol: PNCK
  Gene Name: pregnancy up-regulated nonubiquitous CaM kinase
  ENSP ID: ENSP00000400671

SEQ ID NO: 66399 - protein, 42 aa, Homo sapiens; identical to SEQ ID NO: 66395
  Payload ID: 13240
  Gene Symbol: PNCK
  Gene Name: pregnancy up-regulated nonubiquitous CaM kinase
  ENSP ID: ENSP00000401542

SEQ ID NO: 66400 - protein, 426 aa, Homo sapiens
  Payload ID: 13240
  Gene Symbol: PNCK
  Gene Name: pregnancy up-regulated nonubiquitous CaM kinase
  Uniprot ID: Q6P2M8
  ENSP ID: ENSP00000405950
MEAAFGQVAGSACPRRGGEGRDWKAESLADLWPKSSPGDSHRWCKGPGAGPAGPQLREAARASSGLGGGGRHPSRIPAIALQDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 66401 - protein, 42 aa, Homo sapiens; identical to SEQ ID NO: 66395
  Payload ID: 13240
  Gene Symbol: PNCK
  Gene Name: pregnancy up-regulated nonubiquitous CaM kinase
  ENSP ID: ENSP00000407173

SEQ ID NO: 66402 - protein, 94 aa, Homo sapiens
  Payload ID: 13240
  Gene Symbol: PNCK
  Gene Name: pregnancy up-regulated nonubiquitous CaM kinase
  ENSP ID: ENSP00000411267
MLLLKKHTEDISSVYEIRERLGSGAFSEVVLAQERGSAHLVALKCIPKKALRGKEALVENEIAVLRRRFLAIAGSVTPTSSLWRMSTRALPTST

SEQ ID NO: 66403 - protein, 226 aa, Homo sapiens
  Payload ID: 13240
  Gene Symbol: PNCK
  Gene Name: pregnancy up-regulated nonubiquitous CaM kinase
  ENSP ID: ENSP00000415770
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILR

SEQ ID NO: 66404 - protein, 1627 aa, Homo sapiens
  Payload ID: 13241
  Gene Symbol: PAPPA
  Gene Name: pregnancy-associated plasma protein A, pappalysin 1
  Uniprot ID: Q13219
  ENSP ID: ENSP00000330658
MRLWSWVLHLGLLSAALGCGLAERPRRARRDPRAGRPPRPAAGPATCATRAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 66405 - protein, 1482 aa, Homo sapiens
  Payload ID: 13242
  Gene Symbol: PZP
  Gene Name: pregnancy-zone protein
  Uniprot ID: P20742
  ENSP ID: ENSP00000261336
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGNERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 66406 - protein, 144 aa, Homo sapiens
  Payload ID: 13242
  Gene Symbol: PZP
  Gene Name: pregnancy-zone protein
  ENSP ID: ENSP00000440811
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTGK

SEQ ID NO: 66407 - protein, 219 aa, Homo sapiens
  Payload ID: 13243
  Gene Symbol: PRELID1
  Gene Name: PRELI domain containing 1
  Uniprot ID: Q9Y255
  ENSP ID: ENSP00000302114
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 66408 - protein, 109 aa, Homo sapiens [sequence omitted]

SEQ ID NO: 66409 - protein, 37 aa, Homo sapiens
  Payload ID: 13243
  Gene Symbol: PRELID1
  Gene Name: PRELI domain containing 1
  ENSP ID: ENSP00000423873
MVKYFLGQSVLRSSWDQVFAAFWQRYPNPYSLLGASF

SEQ ID NO: 66410 - protein, 203 aa, Homo sapiens
  Payload ID: 13243
  Gene Symbol: PRELID1
  Gene Name: PRELI domain containing 1
  ENSP ID: ENSP00000426351
  MOD_RES (1)..(1): Any amino acid
XRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGKLGWSFRHLLKAATCRSRQARPLPKHLLRQPRKPRRRQRRRHWQLQRRPRTSPARRPPRSSSSSNSLCSQSTTTTAPQTARLS

SEQ ID NO: 66411 - protein, 208 aa, Homo sapiens
  Payload ID: 13243
  Gene Symbol: PRELID1
  Gene Name: PRELI domain containing 1
  Uniprot ID: Q9Y255
  ENSP ID: ENSP00000427097
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQAKEAKEKAKETALAATEKAKDLASKAATKKQQQQQQFV

SEQ ID NO: 66412 - protein, 189 aa, Homo sapiens
  Payload ID: 13244
  Gene Symbol: PRELID2
  Gene Name: PRELI domain containing 2
  Uniprot ID: Q8N945
  ENSP ID: ENSP00000335675
MGVSVDVHQVYKYPFEQVVASFLRKYPNPMDKNVISVKIMEEKRDESTGVIYRKRIAICQNVVPEILRKSLSTLVILCWKKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 66413 - protein, 148 aa, Homo sapiens
  Payload ID: 13244
  Gene Symbol: PRELID2
  Gene Name: PRELI domain containing 2
  Uniprot ID: Q8N945
  ENSP ID: ENSP00000377965
MDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 66414 - protein, 164 aa, Homo sapiens
  Payload ID: 13244
  Gene Symbol: PRELID2
  Gene Name: PRELI domain containing 2
  ENSP ID: ENSP00000422789
MGVSVDVHQVYKYPFEQVVASFLRKYPNPMDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKVTIFLL

SEQ ID NO: 66415 - protein, 177 aa, Homo sapiens
  Payload ID: 13244
  Gene Symbol: PRELID2
  Gene Name: PRELI domain containing 2
  Uniprot ID: Q8N945
  ENSP ID: ENSP00000424730
MGVSVDVHQVYKYPFEQVVASFLRKYPNPMDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 66416 - protein, 172 aa, Homo sapiens
  Payload ID: 13245
  Gene Symbol: PRELID3A
  Gene Name: PRELI domain containing 3A
  Uniprot ID: Q96N28
  ENSP ID: ENSP00000338988
MKIWSSEHVFGHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 66417 - protein, 172 aa, Homo sapiens; identical to SEQ ID NO: 66416
  Payload ID: 13245
  Gene Symbol: PRELID3A
  Gene Name: PRELI domain containing 3A
  Uniprot ID: Q96N28
  ENSP ID: ENSP00000404700

SEQ ID NO: 66418 - protein, 82 aa, Homo sapiens
  Payload ID: 13245
  Gene Symbol: PRELID3A
  Gene Name: PRELI domain containing 3A
  ENSP ID: ENSP00000464848
MELCSTNITLTNLVSVNERLVYTPHPENPEMTVLTQEAIITVKGISLGSYLESLMANTISSNAKKGWAAIEWIIEHSESAVS

SEQ ID NO: 66419 - protein, 181 aa, Homo sapiens
  Payload ID: 13245
  Gene Symbol: PRELID3A
  Gene Name: PRELI domain containing 3A
  ENSP ID: ENSP00000465996
MAPLHSCLLGDRVRPCLRQTKTKGLPGAEACSHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAI

SEQ ID NO: 66420 - protein, 151 aa, Homo sapiens
  Payload ID: 13245
  Gene Symbol: PRELID3A
  Gene Name: PRELI domain containing 3A
  Uniprot ID: Q96N28
  ENSP ID: ENSP00000466737
MRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 66421 - protein, 82 aa, Homo sapiens; identical to SEQ ID NO: 66418
  Payload ID: 13245
  Gene Symbol: PRELID3A
  Gene Name: PRELI domain containing 3A
  ENSP ID: ENSP00000467026

SEQ ID NO: 66422 - protein, 47 aa, Homo sapiens
  Payload ID: 13245
  Gene Symbol: PRELID3A
  Gene Name: PRELI domain containing 3A
  ENSP ID: ENSP00000467261
MELCSTNAGVQWISAPCNLHFMGSSDSPVSPSQVAGTTDHTHKFGVS

SEQ ID NO: 66423 - protein, 133 aa, Homo sapiens
  Payload ID: 13245
  Gene Symbol: PRELID3A
  Gene Name: PRELI domain containing 3A
  ENSP ID: ENSP00000467457
MRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAK

SEQ ID NO: 66424 - protein, 166 aa, Homo sapiens
  Payload ID: 13245
  Gene Symbol: PRELID3A
  Gene Name: PRELI domain containing 3A
  ENSP ID: ENSP00000467896
MKIWSSEHVFGQNLALSPRLECSGTILAHHNLCLSGSSNSCASASRVAGTTGVCHHACHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENP

SEQ ID NO: 66425 - protein, 194 aa, Homo sapiens
  Payload ID: 13246
  Gene Symbol: PRELID3B
  Gene Name: PRELI domain containing 3B
  Uniprot ID: Q9Y3B1
  ENSP ID: ENSP00000348206
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 66426 - protein, 164 aa, Homo sapiens
  Payload ID: 13246
  Gene Symbol: PRELID3B
  Gene Name: PRELI domain containing 3B
  Uniprot ID: Q9Y3B1
  ENSP ID: ENSP00000360072
MKIWTSEHVFDHPWETVTTAAMQKYPNPMNPSVVGVDVLDRHIDPSGKLHSHRLLSTEWGLPSIVKSISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 66427 - protein, 68 aa, Homo sapiens
  Payload ID: 13246
  Gene Symbol: PRELID3B
  Gene Name: PRELI domain containing 3B
  ENSP ID: ENSP00000431440
MKIWTSEHVFDHPWETVTTAAMQKYPNPMNPSVVGVDVLDRHIDPSGKLHSHRLLSTEWGLPSIVKSF

SEQ ID NO: 66428 - protein, 589 aa, Homo sapiens
  Payload ID: 13247
  Gene Symbol: POF1B
  Gene Name: premature ovarian failure, 1B
  Uniprot ID: Q8WVV4
  ENSP ID: ENSP00000262753
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGGSKQDFESTDESEDIESLIPKGLSEFTKQQIRYILQMRGMSDKSLRLVLSTFSNIREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCP

SEQ ID NO: 66429 - protein, 595 aa, Homo sapiens
  Payload ID: 13247
  Gene Symbol: POF1B
  Gene Name: premature ovarian failure, 1B
  Uniprot ID: Q8WVV4
  ENSP ID: ENSP00000362238
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGGSKQDFESTDESEDIESLIPKGLSEFTKQQIRYILQMRGMSDKSLRLVLSTFSNIREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCVSSLGHF

SEQ ID NO: 66430 - protein, 668 aa, Homo sapiens
  Payload ID: 13248
  Gene Symbol: PMEL
  Gene Name: premelanosome protein
  Uniprot ID: P40967
  ENSP ID: ENSP00000402758
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 66431 - protein, 151 aa, Homo sapiens
  Payload ID: 13248
  Gene Symbol: PMEL
  Gene Name: premelanosome protein
  ENSP ID: ENSP00000446633
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVY

SEQ ID NO: 66432 - protein, 299 aa, Homo sapiens
  Payload ID: 13248
  Gene Symbol: PMEL
  Gene Name: premelanosome protein
  ENSP ID: ENSP00000446662
MDLVLKRCLLHLAVIGALLAVGATKVPRNQDWLGVSRQLRTKAWNRQLYPEWTEAQRLDCWRGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGT

SEQ ID NO: 66433 - protein, 661 aa, Homo sapiens
  Payload ID: 13248
  Gene Symbol: PMEL
  Gene Name: premelanosome protein
  Uniprot ID: P40967
  ENSP ID: ENSP00000447374
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 66434 - protein, 296 aa, Homo sapiens
  Payload ID: 13248
  Gene Symbol: PMEL
  Gene Name: premelanosome protein
  ENSP ID: ENSP00000447732
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTL

SEQ ID NO: 66435 - protein, 290 aa, Homo sapiens
  Payload ID: 13248
  Gene Symbol: PMEL
  Gene Name: premelanosome protein
  ENSP ID: ENSP00000448029
MDLVLKRCLLHLAVIGALLAVGATKGGQVSLKVSNDGPTLIGANASFSIALNFPGSQKVLPDGQVIWVNNTIINGSQVWGGQPVYPQETDDACIFPDGGPCPSGSWSQKRSFVYVWKTWEGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 66436 - protein, 661 aa, Homo sapiens; identical to SEQ ID NO: 66433
  Payload ID: 13248
  Gene Symbol: PMEL
  Gene Name: premelanosome protein
  Uniprot ID: P40967
  ENSP ID: ENSP00000448828

SEQ ID NO: 66437 - protein, 344 aa, Homo sapiens
  Payload ID: 13248
  Gene Symbol: PMEL
  Gene Name: premelanosome protein
  ENSP ID: ENSP00000448849
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEAT

SEQ ID NO: 66438 - protein, 134 aa, Homo sapiens
  Payload ID: 13248
  Gene Symbol: PMEL
  Gene Name: premelanosome protein
  ENSP ID: ENSP00000448871
MGKEEIPRPTLTSVKTLLYTKEFPQTVKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACI

SEQ ID NO: 66439 - protein, 452 aa, Homo sapiens
  Payload ID: 13248
  Gene Symbol: PMEL
  Gene Name: premelanosome protein
  ENSP ID: ENSP00000449520
  MOD_RES (1)..(1): Any amino acid
XQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLI

SEQ ID NO: 66440 - protein, 661 aa, Homo sapiens; identical to SEQ ID NO: 66433
  Payload ID: 13248
  Gene Symbol: PMEL
  Gene Name: premelanosome protein
  Uniprot ID: P40967
  ENSP ID: ENSP00000449690

SEQ ID NO: 66441 - protein, 575 aa, Homo sapiens
  Payload ID: 13248
  Gene Symbol: PMEL
  Gene Name: premelanosome protein
  Uniprot ID: P40967
  ENSP ID: ENSP00000450036
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 66442 - protein, 167 aa, Homo sapiens
  Payload ID: 13249
  Gene Symbol: PRPF18
  Gene Name: pre-mRNA processing factor 18
  ENSP ID: ENSP00000367824
MIRTFPGENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDH

SEQ ID NO: 66443 - protein, 342 aa, Homo sapiens
  Payload ID: 13249
  Gene Symbol: PRPF18
  Gene Name: pre-mRNA processing factor 18
  Uniprot ID: Q99633
  ENSP ID: ENSP00000367835
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 66444 - protein, 249 aa, Homo sapiens
  Payload ID: 13249
  Gene Symbol: PRPF18
  Gene Name: pre-mRNA processing factor 18
  ENSP ID: ENSP00000392142
MIRTFPGENKKYFKRSELAKKEEEAYFERCGYKPINEKPSGEIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIK

SEQ ID NO: 66445 - protein, 504 aa, Homo sapiens
  Payload ID: 13250
  Gene Symbol: PRPF19
  Gene Name: pre-mRNA processing factor 19
  Uniprot ID: Q9UMS4
  ENSP ID: ENSP00000227524
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 66446 - protein, 252 aa, Homo sapiens
  Payload ID: 13250
  Gene Symbol: PRPF19
  Gene Name: pre-mRNA processing factor 19
  ENSP ID: ENSP00000440266
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGTMDSQIKIWDLK

SEQ ID NO: 66447 - protein, 45 aa, Homo sapiens
  Payload ID: 13250
  Gene Symbol: PRPF19
  Gene Name: pre-mRNA processing factor 19
  ENSP ID: ENSP00000443031
IIQKLQDKATVLTTERKKRGKTVPEELVKPEELSKYRQEGLCRVL

SEQ ID NO: 66448 - protein, 119 aa, Homo sapiens
  Payload ID: 13250
  Gene Symbol: PRPF19
  Gene Name: pre-mRNA processing factor 19
  ENSP ID: ENSP00000445435
YWAFSDIQTGRVLTKVTDETSGCSLTCAQFHPDGLIFGTGTMDSQIKIWDLKVKSLIFDQSGTYLALGGTDVQIYICKQWTEILHFTEHSGLTTGVAFGHHAKFIASTGMDRSLKFYSL

SEQ ID NO: 66449 - protein, 104 aa, Homo sapiens
  Payload ID: 13250
  Gene Symbol: PRPF19
  Gene Name: pre-mRNA processing factor 19
  ENSP ID: ENSP00000446259
MLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKK

SEQ ID NO: 66450 - protein, 683 aa, Homo sapiens
  Payload ID: 13251
  Gene Symbol: PRPF3
  Gene Name: pre-mRNA processing factor 3
  Uniprot ID: O43395
  ENSP ID: ENSP00000315379
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 66451 - protein, 499 aa, Homo sapiens
  Payload ID: 13252
  Gene Symbol: PRPF31
  Gene Name: pre-mRNA processing factor 31
  Uniprot ID: Q8WWY3
  ENSP ID: ENSP00000324122
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 66452 - protein, 493 aa, Homo sapiens
  Payload ID: 13252
  Gene Symbol: PRPF31
  Gene Name: pre-mRNA processing factor 31
  ENSP ID: ENSP00000375635
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 66453 - protein, 260 aa, Homo sapiens
  Payload ID: 13252
  Gene Symbol: PRPF31
  Gene Name: pre-mRNA processing factor 31
  ENSP ID: ENSP00000395089
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLS

SEQ ID NO: 66454 - protein, 284 aa, Homo sapiens
  Payload ID: 13252
  Gene Symbol: PRPF31
  Gene Name: pre-mRNA processing factor 31
  ENSP ID: ENSP00000395894
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLP

SEQ ID NO: 66455 - protein, 491 aa, Homo sapiens
  Payload ID: 13252
  Gene Symbol: PRPF31
  Gene Name: pre-mRNA processing factor 31
  Uniprot ID: Q8WWY3
  ENSP ID: ENSP00000405166
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQVWARPRWGWGPRDTRWGEPRSQPPCPPHSGPCRSRASYMAGSPPSATAPRARPPAWPSPHSRAWRL

SEQ ID NO: 66456 - protein, 276 aa, Homo sapiens
  Payload ID: 13252
  Gene Symbol: PRPF31
  Gene Name: pre-mRNA processing factor 31
  ENSP ID: ENSP00000408980
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYH

SEQ ID NO: 66457 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000477787

SEQ ID NO: 66458 - protein, 276 aa, Homo sapiens; identical to SEQ ID NO: 66456
  Payload ID: 13252
  Gene Symbol: PRPF31
  Gene Name: pre-mRNA processing factor 31
  ENSP ID: ENSP00000478043

SEQ ID NO: 66459 - protein, 260 aa, Homo sapiens; identical to SEQ ID NO: 66453
  Payload ID: 13252
  Gene Symbol: PRPF31
  Gene Name: pre-mRNA processing factor 31
  ENSP ID: ENSP00000478554

SEQ ID NO: 66460 - protein, 491 aa, Homo sapiens; identical to SEQ ID NO: 66455
  Payload ID: 13252
  Gene Symbol: PRPF31
  Gene Name: pre-mRNA processing factor 31
  Uniprot ID: Q8WWY3
  ENSP ID: ENSP00000478804

SEQ ID NO: 66461 - protein, 493 aa, Homo sapiens; identical to SEQ ID NO: 66452
  Payload ID: 13252
  Gene Symbol: PRPF31
  Gene Name: pre-mRNA processing factor 31
  ENSP ID: ENSP00000479035

SEQ ID NO: 66462 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000479700

SEQ ID NO: 66463 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000480434

SEQ ID NO: 66464 - protein, 491 aa, Homo sapiens; identical to SEQ ID NO: 66455
  Payload ID: 13252
  Gene Symbol: PRPF31
  Gene Name: pre-mRNA processing factor 31
  Uniprot ID: Q8WWY3
  ENSP ID: ENSP00000480636

SEQ ID NO: 66465 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000480725

SEQ ID NO: 66466 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000480726

SEQ ID NO: 66467 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000481201

SEQ ID NO: 66468 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000481654

SEQ ID NO: 66469 - protein, 491 aa, Homo sapiens; identical to SEQ ID NO: 66455
  Payload ID: 13252
  Gene Symbol: PRPF31
  Gene Name: pre-mRNA processing factor 31
  Uniprot ID: Q8WWY3
  ENSP ID: ENSP00000481708

SEQ ID NO: 66470 - protein, 499 aa, Homo sapiens; identical to SEQ ID NO: 66451
  Payload ID: 13252
  Gene Symbol: PRPF31
  Gene Name: pre-mRNA processing factor 31
  ENSP ID: ENSP00000482626

SEQ ID NO: 66471 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000483382

SEQ ID NO: 66472 - protein, 284 aa, Homo sapiens; identical to SEQ ID NO: 66454
  Payload ID: 13252
  Gene Symbol: PRPF31
  Gene Name: pre-mRNA processing factor 31
  ENSP ID: ENSP00000483828

SEQ ID NO: 66473 - protein, 499 aa, Homo sapiens; identical to SEQ ID NO: 66451
  Payload ID: 13252
  Gene Symbol: PRPF31
  Gene Name: pre-mRNA processing factor 31
  Uniprot ID: Q8WWY3
  ENSP ID: ENSP00000483929

SEQ ID NO: 66474 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000483982

SEQ ID NO: 66475 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000484151

SEQ ID NO: 66476 - protein, 491 aa, Homo sapiens; identical to SEQ ID NO: 66455
  Payload ID: 13252
  Gene Symbol: PRPF31
  Gene Name: pre-mRNA processing factor 31
  ENSP ID: ENSP00000484834

SEQ ID NO: 66477 - protein, 499 aa, Homo sapiens; identical to SEQ ID NO: 66451
  Payload ID: 13252
  Gene Symbol: PRPF31
  Gene Name: pre-mRNA processing factor 31
  Uniprot ID: Q8WWY3
  ENSP ID: ENSP00000484896

SEQ ID NO: 66478 - protein, 499 aa, Homo sapiens; identical to SEQ ID NO: 66451
  Payload ID: 13252
  Gene Symbol: PRPF31
  Gene Name: pre-mRNA processing factor 31
  Uniprot ID: Q8WWY3
  ENSP ID: ENSP00000485017

SEQ ID NO: 66479 - protein, 312 aa, Homo sapiens
  Payload ID: 13253
  Gene Symbol: PRPF38A
  Gene Name: pre-mRNA processing factor 38A
  Uniprot ID: Q8NAV1
  ENSP ID: ENSP00000257181
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 66480 - protein, 435 aa, Homo sapiens
  Payload ID: 13254
  Gene Symbol: PRPF38B
  Gene Name: pre-mRNA processing factor 38B
  ENSP ID: ENSP00000359038
MCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 66481 - protein, 190 aa, Homo sapiens
  Payload ID: 13254
  Gene Symbol: PRPF38B
  Gene Name: pre-mRNA processing factor 38B
  Uniprot ID: Q5VTL8
  ENSP ID: ENSP00000359039
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEFFTL

SEQ ID NO: 66482 - protein, 546 aa, Homo sapiens
  Payload ID: 13254
  Gene Symbol: PRPF38B
  Gene Name: pre-mRNA processing factor 38B
  Uniprot ID: Q5VTL8
  ENSP ID: ENSP00000359042
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 66483 - protein, 669 aa, Homo sapiens
  Payload ID: 13255
  Gene Symbol: PRPF39
  Gene Name: pre-mRNA processing factor 39
  Uniprot ID: Q86UA1
  ENSP ID: ENSP00000348010
MQNSHMDEYRNSSNGSTGNSSEVVVEHPTDFSTEIMNVTEMEQSPDDSPNVNASTEETEMASAVDLPVTLTETEANFPPEYEKFWKTVENNPQDFTGWVYLLQYVEQENHLMAARKAFDRFFIHYPYCYGYWKKYADLEKRHDNIKPSDEVYRRGLQAIPLSVDLWIHYINFLKETLDPGDPETNNTIRGTFEHAVLAAGTDFRSDRLWEMYINWENEQGNLREVTAIYDRILGIPTQLYSHHFQRFKEHVQNNLPRDLLTGEQFIQLRRELASVNGHSGDDGPPGDDLPSGIEDITDPAKLITEIENMRHRIIEIHQEMFNYNEHEVSKRWTFEEGIKRPYFHVKPLEKAQLKNWKEYLEFEIENGTHERVVVLFERCVISCALYEEFWIKYAKYMENHSIEGVRHVFSRACTIHLPKKPMVHMLWAAFEEQQGNINEARNILKTFEECVLGLAMVRLRRVSLERRHGNLEEAEHLLQDAIKNAKSNNESSFYAVKLARHLFKIQKNLPKSRKVLLEAIERDKENTKLYLNLLEMEYSGDLKQNEENILNCFDKAVHGSLPIKMRITFSQRKVEFLEDFGSDVNKLLNAYDEHQTLLKEQDSLKRKAENGSEEPEEKKAHTEDTTSSSTQMIDGDLQANQAVYNYSAWYQYNYQNPWNYGQYYPPPPT

SEQ ID NO: 66484 - protein, 152 aa, Homo sapiens
  Payload ID: 13255
  Gene Symbol: PRPF39
  Gene Name: pre-mRNA processing factor 39
  ENSP ID: ENSP00000390867
MQNSHMDEYRNSSNGSTGNSSEVVVEHPTDFSTEIMNVTEMEQSPDDSPNVNASTEETEMASAVDLPVTLTETEANFPPEYEKFWKTVENNPQDFTGWVYLLQYVEQENHLMAARKAFDRFFIHYPYCYGYWKKYADLEKRHDNIKPSDEVR

SEQ ID NO: 66485 - protein, 152 aa, Homo sapiens; identical to SEQ ID NO: 66484
  Payload ID: 13255
  Gene Symbol: PRPF39
  Gene Name: pre-mRNA processing factor 39
  ENSP ID: ENSP00000451331

SEQ ID NO: 66486 - protein, 152 aa, Homo sapiens; identical to SEQ ID NO: 66484
  Payload ID: 13255
  Gene Symbol: PRPF39
  Gene Name: pre-mRNA processing factor 39
  ENSP ID: ENSP00000451334

SEQ ID NO: 66487 - protein, 17 aa, Homo sapiens
  Payload ID: 13255
  Gene Symbol: PRPF39
  Gene Name: pre-mRNA processing factor 39
  ENSP ID: ENSP00000451988
  MOD_RES (1)..(1): Any amino acid
XRHDNIKPSDETLSLML

SEQ ID NO: 66488 - protein, 140 aa, Homo sapiens
  Payload ID: 13255
  Gene Symbol: PRPF39
  Gene Name: pre-mRNA processing factor 39
  ENSP ID: ENSP00000452428
MQNSHMDEYRNSSNGSTGNSSEVVVEHPTDFSTEIMNVTEMEQSPDDSPNVNASTEETEMASAVDLPVTLTETEANFPPEYEKFWKTVENNPQDFTGWNHLMAARKAFDRFFIHYPYCYGYWKKYADLEKRHDNIKPSDE

SEQ ID NO: 66489 - protein, 90 aa, Homo sapiens
  Payload ID: 13255
  Gene Symbol: PRPF39
  Gene Name: pre-mRNA processing factor 39
  ENSP ID: ENSP00000452516
  MOD_RES (1)..(1): Any amino acid
XAIPLSVDLWIHYINFLKETLDPGDPETNNTIRGTFEHAVLAAGTDFRSDRLWEMYINWENEQGNLREVTAIYDRILGIPTQLYSHHFQS

SEQ ID NO: 66490 - protein, 522 aa, Homo sapiens
  Payload ID: 13256
  Gene Symbol: PRPF4
  Gene Name: pre-mRNA processing factor 4
  Uniprot ID: O43172
  ENSP ID: ENSP00000363313
MASSRASSTQATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 66491 - protein, 521 aa, Homo sapiens
  Payload ID: 13256
  Gene Symbol: PRPF4
  Gene Name: pre-mRNA processing factor 4
  Uniprot ID: O43172
  ENSP ID: ENSP00000363315
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 66492 - protein, 1007 aa, Homo sapiens
  Payload ID: 13257
  Gene Symbol: PRPF4B
  Gene Name: pre-mRNA processing factor 4B
  Uniprot ID: Q13523
  ENSP ID: ENSP00000337194
MAAAETQSLREQPEMEDANSEKSINEENGEVSEDQSQNKHSRHKKKKHKHRSKHKKHKHSSEEDKDKKHKHKHKHKKHKRKEIIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 66493 - protein, 1007 aa, Homo sapiens; identical to SEQ ID NO: 66492
  Payload ID: 13257
  Gene Symbol: PRPF4B
  Gene Name: pre-mRNA processing factor 4B
  Uniprot ID: Q13523
  ENSP ID: ENSP00000433547

SEQ ID NO: 66494 - protein, 587 aa, Homo sapiens
  Payload ID: 13257
  Gene Symbol: PRPF4B
  Gene Name: pre-mRNA processing factor 4B
  ENSP ID: ENSP00000433714
LSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 66495 - protein, 941 aa, Homo sapiens
  Payload ID: 13258
  Gene Symbol: PRPF6
  Gene Name: pre-mRNA processing factor 6
  Uniprot ID: O94906
  ENSP ID: ENSP00000266079
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 66496 - protein, 2335 aa, Homo sapiens
  Payload ID: 13259
  Gene Symbol: PRPF8
  Gene Name: pre-mRNA processing factor 8
  Uniprot ID: Q6P2Q9
  ENSP ID: ENSP00000304350
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 66497 - protein, 1012 aa, Homo sapiens
  Payload ID: 13259
  Gene Symbol: PRPF8
  Gene Name: pre-mRNA processing factor 8
  ENSP ID: ENSP00000458151
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQM

SEQ ID NO: 66498 - protein, 116 aa, Homo sapiens
  Payload ID: 13259
  Gene Symbol: PRPF8
  Gene Name: pre-mRNA processing factor 8
  ENSP ID: ENSP00000459095
  MOD_RES (1)..(1): Any amino acid
XPSGYEWGRQNTDKGNNPKGYLPSHYERVQMLLSDRFLGFFMVPAQSSWNYNFMGGGGLLCGSGGPVCLTVSLPPASASRGRSLSPSRQAADIQQFGLFPSVCACVVDLLMACHPE

SEQ ID NO: 66499 - protein, 2335 aa, Homo sapiens; identical to SEQ ID NO: 66496
  Payload ID: 13259
  Gene Symbol: PRPF8
  Gene Name: pre-mRNA processing factor 8
  Uniprot ID: Q6P2Q9
  ENSP ID: ENSP00000460348

SEQ ID NO: 66500 - protein, 250 aa, Homo sapiens
  Payload ID: 13259
  Gene Symbol: PRPF8
  Gene Name: pre-mRNA processing factor 8
  ENSP ID: ENSP00000460849
  MOD_RES (1)..(1): Any amino acid
XRIKIGLNSKMPSRFPPVVFYTPKELGGLGMLSMGHVLIPQSDLRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEI

SEQ ID NO: 66501 - protein, 2335 aa, Homo sapiens; identical to SEQ ID NO: 66496
  Payload ID: 13259
  Gene Symbol: PRPF8
  Gene Name: pre-mRNA processing factor 8
  Uniprot ID: Q6P2Q9
  ENSP ID: ENSP00000479194

SEQ ID NO: 66502 - protein, 1012 aa, Homo sapiens; identical to SEQ ID NO: 66497
  Payload ID: 13259
  Gene Symbol: PRPF8
  Gene Name: pre-mRNA processing factor 8
  ENSP ID: ENSP00000488222

SEQ ID NO: 66503 - protein, 2335 aa, Homo sapiens; identical to SEQ ID NO: 66496
  Payload ID: 13259
  Gene Symbol: PRPF8
  Gene Name: pre-mRNA processing factor 8
  Uniprot ID: Q6P2Q9
  ENSP ID: ENSP00000488611

SEQ ID NO: 66504 - protein, 415 aa, Homo sapiens
  Payload ID: 13260
  Gene Symbol: PDSS1
  Gene Name: prenyl (decaprenyl) diphosphate synthase, subunit 1
  Uniprot ID: Q5T2R2
  ENSP ID: ENSP00000365388
MASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 66505 - protein, 158 aa, Homo sapiens
  Payload ID: 13260
  Gene Symbol: PDSS1
  Gene Name: prenyl (decaprenyl) diphosphate synthase, subunit 1
  ENSP ID: ENSP00000435695
  MOD_RES (1)..(1): Any amino acid
XWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQVHCQGKTGSCCKH

SEQ ID NO: 66506 - protein, 240 aa, Homo sapiens
  Payload ID: 13261
  Gene Symbol: PDSS2
  Gene Name: prenyl (decaprenyl) diphosphate synthase, subunit 2
  Uniprot ID: Q86YH6
  ENSP ID: ENSP00000358027
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKSFSFNGPIAIYQMGDCESAWILSKHPRALS

SEQ ID NO: 66507 - protein, 399 aa, Homo sapiens
  Payload ID: 13261
  Gene Symbol: PDSS2
  Gene Name: prenyl (decaprenyl) diphosphate synthase, subunit 2
  Uniprot ID: Q86YH6
  ENSP ID: ENSP00000358033
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKLRERIKAGKGVTSAIDLCRYHGNKALEALESFPPSEARSALENIVFAVTRFS

SEQ ID NO: 66508 - protein, 80 aa, Homo sapiens
  Payload ID: 13261
  Gene Symbol: PDSS2
  Gene Name: prenyl (decaprenyl) diphosphate synthase, subunit 2
  ENSP ID: ENSP00000392613
VQNMAFQYGKHMAMSHKINSDVQPFIKEKTSDSMTFNLNSAPVVLHQEFLGRDLWIKQIGESSSTEVQLSNFQQMLLSTL

SEQ ID NO: 66509 - protein, 293 aa, Homo sapiens
  Payload ID: 13262
  Gene Symbol: PCYOX1
  Gene Name: prenylcysteine oxidase 1
  ENSP ID: ENSP00000264441
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTVLGLCPL

SEQ ID NO: 66510 - protein, 505 aa, Homo sapiens
  Payload ID: 13262
  Gene Symbol: PCYOX1
  Gene Name: prenylcysteine oxidase 1
  Uniprot ID: Q9UHG3
  ENSP ID: ENSP00000387654
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 66511 - protein, 129 aa, Homo sapiens
  Payload ID: 13262
  Gene Symbol: PCYOX1
  Gene Name: prenylcysteine oxidase 1
  ENSP ID: ENSP00000404327
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKA

SEQ ID NO: 66512 - protein, 154 aa, Homo sapiens
  Payload ID: 13262
  Gene Symbol: PCYOX1
  Gene Name: prenylcysteine oxidase 1
  ENSP ID: ENSP00000408751
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDI

SEQ ID NO: 66513 - protein, 209 aa, Homo sapiens
  Payload ID: 13262
  Gene Symbol: PCYOX1
  Gene Name: prenylcysteine oxidase 1
  ENSP ID: ENSP00000413178
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYT

SEQ ID NO: 66514 - protein, 494 aa, Homo sapiens
  Payload ID: 13263
  Gene Symbol: PCYOX1L
  Gene Name: prenylcysteine oxidase 1 like
  Uniprot ID: Q8NBM8
  ENSP ID: ENSP00000274569
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 66515 - protein, 111 aa, Homo sapiens
  Payload ID: 13263
  Gene Symbol: PCYOX1L
  Gene Name: prenylcysteine oxidase 1 like
  ENSP ID: ENSP00000422063
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLDGATETREGKELA

SEQ ID NO: 66516 - protein, 82 aa, Homo sapiens
  Payload ID: 13263
  Gene Symbol: PCYOX1L
  Gene Name: prenylcysteine oxidase 1 like
  Uniprot ID: Q8NBM8
  ENSP ID: ENSP00000426091
MARAAPLLAALTALLAAAAAGGDAPPGKIGAGRTRGGWGWDWGLCCGPFSPAALWTSGADRRVREGNRGWPLGHHLSQQAAL

SEQ ID NO: 66517 - protein, 82 aa, Homo sapiens; identical to SEQ ID NO: 66516
  Payload ID: 13263
  Gene Symbol: PCYOX1L
  Gene Name: prenylcysteine oxidase 1 like
  Uniprot ID: Q8NBM8
  ENSP ID: ENSP00000427166

SEQ ID NO: 66518 - protein, 404 aa, Homo sapiens
  Payload ID: 13263
  Gene Symbol: PCYOX1L
  Gene Name: prenylcysteine oxidase 1 like
  ENSP ID: ENSP00000428512
MQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 66519 - protein, 176 aa, Homo sapiens
  Payload ID: 13264
  Gene Symbol: PNOC
  Gene Name: prepronociceptin
  Uniprot ID: Q13519
  ENSP ID: ENSP00000301908
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 66520 - protein, 154 aa, Homo sapiens
  Payload ID: 13264
  Gene Symbol: PNOC
  Gene Name: prepronociceptin
  ENSP ID: ENSP00000428059
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMR

SEQ ID NO: 66521 - protein, 112 aa, Homo sapiens
  Payload ID: 13264
  Gene Symbol: PNOC
  Gene Name: prepronociceptin
  Uniprot ID: Q13519
  ENSP ID: ENSP00000430145
MARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 66522 - protein, 467 aa, Homo sapiens
  Payload ID: 13265
  Gene Symbol: PSEN1
  Gene Name: presenilin 1
  Uniprot ID: P49768
  ENSP ID: ENSP00000326366
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 66523 - protein, 463 aa, Homo sapiens
  Payload ID: 13265
  Gene Symbol: PSEN1
  Gene Name: presenilin 1
  Uniprot ID: P49768
  ENSP ID: ENSP00000350342
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 66524 - protein, 184 aa, Homo sapiens
  Payload ID: 13265
  Gene Symbol: PSEN1
  Gene Name: presenilin 1
  Uniprot ID: P49768
  ENSP ID: ENSP00000377712
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVSMRHRSLLSTLFFLWLGILVTVT

SEQ ID NO: 66525 - protein, 463 aa, Homo sapiens; identical to SEQ ID NO: 66523
  Payload ID: 13265
  Gene Symbol: PSEN1
  Gene Name: presenilin 1
  Uniprot ID: P49768
  ENSP ID: ENSP00000377719

SEQ ID NO: 66526 - protein, 375 aa, Homo sapiens
  Payload ID: 13265
  Gene Symbol: PSEN1
  Gene Name: presenilin 1
  ENSP ID: ENSP00000385948
MVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 66527 - protein, 91 aa, Homo sapiens
  Payload ID: 13265
  Gene Symbol: PSEN1
  Gene Name: presenilin 1
  ENSP ID: ENSP00000450551
MTELPAPLSYFQNAQMSEDNHLSNTNDNRERQEHNDRRSLGHPEPLSNGRPQGNSRQVVEQDEEEDEELTLKYGAKHVIMLFVPVTLCMVV

SEQ ID NO: 66528 - protein, 155 aa, Homo sapiens
  Payload ID: 13265
  Gene Symbol: PSEN1
  Gene Name: presenilin 1
  ENSP ID: ENSP00000450652
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYK

SEQ ID NO: 66529 - protein, 374 aa, Homo sapiens
  Payload ID: 13265
  Gene Symbol: PSEN1
  Gene Name: presenilin 1
  Uniprot ID: P49768
  ENSP ID: ENSP00000450845
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERACLPPAAINLLSIAPMAPRLFMPKGACRPTAQKGSHKTLLQRMMMAGSVRNGKPRGTVI

SEQ ID NO: 66530 - protein, 62 aa, Homo sapiens
  Payload ID: 13265
  Gene Symbol: PSEN1
  Gene Name: presenilin 1
  ENSP ID: ENSP00000451347
MTELPAPLSYFQNAQMSEDNHLSNTNDNRERQEHNDRRSLGHPEPLSNGRPQGNSRQVVEQD

SEQ ID NO: 66531 - protein, 409 aa, Homo sapiens
  Payload ID: 13265
  Gene Symbol: PSEN1
  Gene Name: presenilin 1
  Uniprot ID: P49768
  ENSP ID: ENSP00000451429
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 66532 - protein, 135 aa, Homo sapiens
  Payload ID: 13265
  Gene Symbol: PSEN1
  Gene Name: presenilin 1
  ENSP ID: ENSP00000451498
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIM

SEQ ID NO: 66533 - protein, 63 aa, Homo sapiens
  Payload ID: 13265
  Gene Symbol: PSEN1
  Gene Name: presenilin 1
  ENSP ID: ENSP00000451588
MTELPAPLSYFQNAQMSEDNHLSNTNDNRERQEHNDRRSLGHPEPLSNGRPQGNSRQVVEQDE

SEQ ID NO: 66534 - protein, 42 aa, Homo sapiens
  Payload ID: 13265
  Gene Symbol: PSEN1
  Gene Name: presenilin 1
  ENSP ID: ENSP00000451662
MTELPAPLSYFQNAQMSEDNHLSNTVRSQRRVLAILARLISN

SEQ ID NO: 66535 - protein, 147 aa, Homo sapiens
  Payload ID: 13265
  Gene Symbol: PSEN1
  Gene Name: presenilin 1
  ENSP ID: ENSP00000451674
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLV

SEQ ID NO: 66536 - protein, 99 aa, Homo sapiens
  Payload ID: 13265
  Gene Symbol: PSEN1
  Gene Name: presenilin 1
  ENSP ID: ENSP00000451880
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVAT

SEQ ID NO: 66537 - protein, 109 aa, Homo sapiens
  Payload ID: 13265
  Gene Symbol: PSEN1
  Gene Name: presenilin 1
  ENSP ID: ENSP00000451915
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRK

SEQ ID NO: 66538 - protein, 92 aa, Homo sapiens
  Payload ID: 13265
  Gene Symbol: PSEN1
  Gene Name: presenilin 1
  ENSP ID: ENSP00000452128
MTELPAPLSYFQNAQMSEDNHLSNTNDNRERQEHNDRRSLGHPEPLSNGRPQGNSRQVVEQDEEEDEELTLKYGAKHVIMLFVPVTLCMVVV

SEQ ID NO: 66539 - protein, 378 aa, Homo sapiens
  Payload ID: 13265
  Gene Symbol: PSEN1
  Gene Name: presenilin 1
  Uniprot ID: P49768
  ENSP ID: ENSP00000452242
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERACLPPAAINLLSIAPMAPRLFMPKGACRPTAQKGSHKTLLQRMMMAGSVRNGKPRGTVI

SEQ ID NO: 66540 - protein, 58 aa, Homo sapiens
  Payload ID: 13265
  Gene Symbol: PSEN1
  Gene Name: presenilin 1
  ENSP ID: ENSP00000452267
MTELPAPLSYFQNAQMSEDNHLSNTNDNRERQEHNDRRSLGHPEPLSNGRPQGNSRQV

SEQ ID NO: 66541 - protein, 91 aa, Homo sapiens; identical to SEQ ID NO: 66527
  Payload ID: 13265
  Gene Symbol: PSEN1
  Gene Name: presenilin 1
  ENSP ID: ENSP00000452477

SEQ ID NO: 66542 - protein, 109 aa, Homo sapiens
  Payload ID: 13265
  Gene Symbol: PSEN1
  Gene Name: presenilin 1
  ENSP ID: ENSP00000453466
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQL

SEQ ID NO: 66543 - protein, 57 aa, Homo sapiens
  Payload ID: 13265
  Gene Symbol: PSEN1
  Gene Name: presenilin 1
  ENSP ID: ENSP00000454156
MTELPAPLSYFQNAQMSEDNHLSNTRRVLAILARLISNSWAQVILPLWPPKIQRLWV

SEQ ID NO: 66544 - protein, 481 aa, Homo sapiens
  Payload ID: 13266
  Gene Symbol: PSEN2
  Gene Name: presenilin 2
  ENSP ID: ENSP00000355746
MLAGTVRFARHCLKFFPAQKPACVDFGASRGRAMLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 66545 - protein, 448 aa, Homo sapiens
  Payload ID: 13266
  Gene Symbol: PSEN2
  Gene Name: presenilin 2
  Uniprot ID: P49810
  ENSP ID: ENSP00000355747
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 66546 - protein, 447 aa, Homo sapiens
  Payload ID: 13266
  Gene Symbol: PSEN2
  Gene Name: presenilin 2
  Uniprot ID: P49810
  ENSP ID: ENSP00000403737
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 66547 - protein, 304 aa, Homo sapiens
  Payload ID: 13266
  Gene Symbol: PSEN2
  Gene Name: presenilin 2
  ENSP ID: ENSP00000427806
MISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 66548 - protein, 144 aa, Homo sapiens
  Payload ID: 13266
  Gene Symbol: PSEN2
  Gene Name: presenilin 2
  ENSP ID: ENSP00000427912
MSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQL

SEQ ID NO: 66549 - protein, 21 aa, Homo sapiens
  Payload ID: 13266
  Gene Symbol: PSEN2
  Gene Name: presenilin 2
  ENSP ID: ENSP00000429036
MLTFMASDSEEEVCDERTSLM

SEQ ID NO: 66550 - protein, 129 aa, Homo sapiens
  Payload ID: 13266
  Gene Symbol: PSEN2
  Gene Name: presenilin 2
  ENSP ID: ENSP00000429682
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTP

SEQ ID NO: 66551 - protein, 481 aa, Homo sapiens; identical to SEQ ID NO: 66544
  Payload ID: 13266
  Gene Symbol: PSEN2
  Gene Name: presenilin 2
  ENSP ID: ENSP00000486498

SEQ ID NO: 66552 - protein, 329 aa, Homo sapiens
  Payload ID: 13267
  Gene Symbol: PARL
  Gene Name: presenilin associated, rhomboid-like
  Uniprot ID: Q9H300
  ENSP ID: ENSP00000310676
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASSVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 66553 - protein, 379 aa, Homo sapiens
  Payload ID: 13267
  Gene Symbol: PARL
  Gene Name: presenilin associated, rhomboid-like
  Uniprot ID: Q9H300
  ENSP ID: ENSP00000325421
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 66554 - protein, 112 aa, Homo sapiens
  Payload ID: 13267
  Gene Symbol: PARL
  Gene Name: presenilin associated, rhomboid-like
  ENSP ID: ENSP00000392926
  MOD_RES (1)..(1): Any amino acid
XSIVNILGQEQFMAVYLSAGVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 66555 - protein, 159 aa, Homo sapiens
  Payload ID: 13267
  Gene Symbol: PARL
  Gene Name: presenilin associated, rhomboid-like
  ENSP ID: ENSP00000396691
  MOD_RES (1)..(1): Any amino acid
XRRFNFFIQQKCGFRKAPRKVEPRRSDPGTSGEAYKRSALIPPVEETVFYPSPYPIRSLIKPLFFTVGINKWWNNLSDGQRTVTGIIAANVLVFCLWRVPSLQRTMIRYFTSNPASSVISNFVSYVGKVATGRYGPSLGASGAIMTVLAAVCTKIPEGR

SEQ ID NO: 66556 - protein, 171 aa, Homo sapiens
  Payload ID: 13267
  Gene Symbol: PARL
  Gene Name: presenilin associated, rhomboid-like
  ENSP ID: ENSP00000398043
  MOD_RES (1)..(1): Any amino acid
XQRTMIRYFTSNPASTNMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 66557 - protein, 295 aa, Homo sapiens
  Payload ID: 13267
  Gene Symbol: PARL
  Gene Name: presenilin associated, rhomboid-like
  ENSP ID: ENSP00000402137
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASSVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 66558 - protein, 63 aa, Homo sapiens
  Payload ID: 13267
  Gene Symbol: PARL
  Gene Name: presenilin associated, rhomboid-like
  ENSP ID: ENSP00000402689
HMAANMYVLWSFSSSIVNILGQEQFMAVYLSAGVISNFVSYVGKVATGRYGPSLGAMVCYLRS

SEQ ID NO: 66559 - protein, 173 aa, Homo sapiens
  Payload ID: 13267
  Gene Symbol: PARL
  Gene Name: presenilin associated, rhomboid-like
  ENSP ID: ENSP00000404421
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGLC

SEQ ID NO: 66560 - protein, 101 aa, Homo sapiens
  Payload ID: 13268
  Gene Symbol: PSENEN
  Gene Name: presenilin enhancer gamma secretase subunit
  Uniprot ID: Q9NZ42
  ENSP ID: ENSP00000222266
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 66561 - protein, 101 aa, Homo sapiens; identical to SEQ ID NO: 66560
  Payload ID: 13268
  Gene Symbol: PSENEN
  Gene Name: presenilin enhancer gamma secretase subunit
  Uniprot ID: Q9NZ42
  ENSP ID: ENSP00000468411

SEQ ID NO: 66562 - protein, 97 aa, Homo sapiens
  Payload ID: 13268
  Gene Symbol: PSENEN
  Gene Name: presenilin enhancer gamma secretase subunit
  ENSP ID: ENSP00000468593
MNLERVSNEEKLNLCRKYYLGGFAFLPFLWLVNIFWFFREAFLVPAYTEQSQIKGCESRAQRREASGRGEGEAGNLGGKGQWRIQNVGALGEKGRLV

SEQ ID NO: 66563 - protein, 125 aa, Homo sapiens
  Payload ID: 13269
  Gene Symbol: PAM16
  Gene Name: presequence translocase-associated motor 16 homolog (S. cerevisiae)
  Uniprot ID: Q9Y3D7
  ENSP ID: ENSP00000315693
MAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 66564 - protein, 137 aa, Homo sapiens
  Payload ID: 13269
  Gene Symbol: PAM16
  Gene Name: presequence translocase-associated motor 16 homolog (S. cerevisiae)
  ENSP ID: ENSP00000458412
MESHVQCSGMFSLAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 66565 - protein, 94 aa, Homo sapiens
  Payload ID: 13269
  Gene Symbol: PAM16
  Gene Name: presequence translocase-associated motor 16 homolog (S. cerevisiae)
  ENSP ID: ENSP00000458914
MSLAGQVPGPDHCDGRAGGGQGLCTGLAAGVCSLYPLKRKPLLEKRQLLATCPCVSHPVLVAGVSHQLGRPRVKCGLLRTERSPTCPHSQPGRS

SEQ ID NO: 66566 - protein, 129 aa, Homo sapiens
  Payload ID: 13269
  Gene Symbol: PAM16
  Gene Name: presequence translocase-associated motor 16 homolog (S. cerevisiae)
  ENSP ID: ENSP00000459113
MAKYLAQIIVMGVQVVGRAFARALRQEFAASRAAADARGRAGHRSAAASNLSGLSLQEAQQILNVSKLSPEEVQKNYEHLFKVNDKSVGGSFYLQSKRSGLSMLPKLISNSWPQAILLPWPPKTLGLHA

SEQ ID NO: 66567 - protein, 61 aa, Homo sapiens
  Payload ID: 13269
  Gene Symbol: PAM16
  Gene Name: presequence translocase-associated motor 16 homolog (S. cerevisiae)
  ENSP ID: ENSP00000459802
MAKYLAQIIVMGVQVVGRAFARALRQEFAGVSHQLGRPRVKCGLLRTERSPTCPHSQPGRS

SEQ ID NO: 66568 - protein, 145 aa, Homo sapiens
  Payload ID: 13269
  Gene Symbol: PAM16
  Gene Name: presequence translocase-associated motor 16 homolog (S. cerevisiae)
  ENSP ID: ENSP00000459955
MRWGQSASGSSVKFTRLPACPAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 66569 - protein, 59 aa, Homo sapiens
  Payload ID: 13269
  Gene Symbol: PAM16
  Gene Name: presequence translocase-associated motor 16 homolog (S. cerevisiae)
  ENSP ID: ENSP00000460434
  MOD_RES (1)..(1): Any amino acid
XSPAAGPGSRSLSPGGRAAAMPAGPQLMPEDALDTGLQPLPTSPASASRRHSRFSTCPS

SEQ ID NO: 66570 - protein, 145 aa, Homo sapiens; identical to SEQ ID NO: 66568
  Payload ID: 13269
  Gene Symbol: PAM16
  Gene Name: presequence translocase-associated motor 16 homolog (S. cerevisiae)
  ENSP ID: ENSP00000460708

SEQ ID NO: 66571 - protein, 125 aa, Homo sapiens; identical to SEQ ID NO: 66563
  Payload ID: 13269
  Gene Symbol: PAM16
  Gene Name: presequence translocase-associated motor 16 homolog (S. cerevisiae)
  Uniprot ID: Q9Y3D7
  ENSP ID: ENSP00000461047

SEQ ID NO: 66572 - protein, 125 aa, Homo sapiens; identical to SEQ ID NO: 66563
  Payload ID: 13269
  Gene Symbol: PAM16
  Gene Name: presequence translocase-associated motor 16 homolog (S. cerevisiae)
  Uniprot ID: Q9Y3D7
  ENSP ID: ENSP00000484240

SEQ ID NO: 66573 - protein, 61 aa, Homo sapiens; identical to SEQ ID NO: 66567
  Payload ID: 13269
  Gene Symbol: PAM16
  Gene Name: presequence translocase-associated motor 16 homolog (S. cerevisiae)
  ENSP ID: ENSP00000487648

SEQ ID NO: 66574 - protein, 125 aa, Homo sapiens; identical to SEQ ID NO: 66563
  Payload ID: 13269
  Gene Symbol: PAM16
  Gene Name: presequence translocase-associated motor 16 homolog (S. cerevisiae)
  Uniprot ID: Q9Y3D7
  ENSP ID: ENSP00000487678

SEQ ID NO: 66575 - protein, 129 aa, Homo sapiens; identical to SEQ ID NO: 66566
  Payload ID: 13269
  Gene Symbol: PAM16
  Gene Name: presequence translocase-associated motor 16 homolog (S. cerevisiae)
  ENSP ID: ENSP00000488011

SEQ ID NO: 66576 - protein, 145 aa, Homo sapiens; identical to SEQ ID NO: 66568
  Payload ID: 13269
  Gene Symbol: PAM16
  Gene Name: presequence translocase-associated motor 16 homolog (S. cerevisiae)
  ENSP ID: ENSP00000488047

SEQ ID NO: 66577 - protein, 145 aa, Homo sapiens; identical to SEQ ID NO: 66568
  Payload ID: 13269
  Gene Symbol: PAM16
  Gene Name: presequence translocase-associated motor 16 homolog (S. cerevisiae)
  ENSP ID: ENSP00000488187

SEQ ID NO: 66578 - protein, 137 aa, Homo sapiens; identical to SEQ ID NO: 66564
  Payload ID: 13269
  Gene Symbol: PAM16
  Gene Name: presequence translocase-associated motor 16 homolog (S. cerevisiae)
  ENSP ID: ENSP00000488272

SEQ ID NO: 66579 - protein, 94 aa, Homo sapiens; identical to SEQ ID NO: 66565
  Payload ID: 13269
  Gene Symbol: PAM16
  Gene Name: presequence translocase-associated motor 16 homolog (S. cerevisiae)
  ENSP ID: ENSP00000488543

SEQ ID NO: 66580 - protein, 59 aa, Homo sapiens; identical to SEQ ID NO: 66569
  Payload ID: 13269
  Gene Symbol: PAM16
  Gene Name: presequence translocase-associated motor 16 homolog (S. cerevisiae)
  ENSP ID: ENSP00000488652
  MOD_RES (1)..(1): Any amino acid

SEQ ID NO: 66581 - protein, 265 aa, Homo sapiens
  Payload ID: 13270
  Gene Symbol:
  Gene Name: PRH1-PRR4
  ENSP ID: ENSP00000482961
MRVGVSLCYPGWSSVVGSWLTAVWNSWAQTILPPQPSAAEEYFACWNLLYLLKSGSFHRELTRFSQHKVGSDTRASCKMLLILLSVALLAFSSAQDLNEDVSQEDVPLVISDGGDSEQFLDEERQGPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 66582 - protein, 265 aa, Homo sapiens; identical to SEQ ID NO: 66581
  Payload ID: 13270
  Gene Symbol:
  Gene Name: PRH1-PRR4
  ENSP ID: ENSP00000488008

SEQ ID NO: 66583 - protein, 831 aa, Homo sapiens
  Payload ID: 13271
  Gene Symbol: PRICKLE1
  Gene Name: prickle homolog 1
  Uniprot ID: Q96MT3
  ENSP ID: ENSP00000345064
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATSDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 66584 - protein, 831 aa, Homo sapiens; identical to SEQ ID NO: 66583
  Payload ID: 13271
  Gene Symbol: PRICKLE1
  Gene Name: prickle homolog 1
  Uniprot ID: Q96MT3
  ENSP ID: ENSP00000398947

SEQ ID NO: 66585 - protein, 831 aa, Homo sapiens; identical to SEQ ID NO: 66583
  Payload ID: 13271
  Gene Symbol: PRICKLE1
  Gene Name: prickle homolog 1
  Uniprot ID: Q96MT3
  ENSP ID: ENSP00000401060

SEQ ID NO: 66586 - protein, 109 aa, Homo sapiens
  Payload ID: 13271
  Gene Symbol: PRICKLE1
  Gene Name: prickle homolog 1
  ENSP ID: ENSP00000446699
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEAL

SEQ ID NO: 66587 - protein, 119 aa, Homo sapiens
  Payload ID: 13271
  Gene Symbol: PRICKLE1
  Gene Name: prickle homolog 1
  ENSP ID: ENSP00000446970
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSR

SEQ ID NO: 66588 - protein, 159 aa, Homo sapiens
  Payload ID: 13271
  Gene Symbol: PRICKLE1
  Gene Name: prickle homolog 1
  ENSP ID: ENSP00000447870
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCF

SEQ ID NO: 66589 - protein, 831 aa, Homo sapiens; identical to SEQ ID NO: 66583
  Payload ID: 13271
  Gene Symbol: PRICKLE1
  Gene Name: prickle homolog 1
  Uniprot ID: Q96MT3
  ENSP ID: ENSP00000448359

SEQ ID NO: 66590 - protein, 831 aa, Homo sapiens; identical to SEQ ID NO: 66583
  Payload ID: 13271
  Gene Symbol: PRICKLE1
  Gene Name: prickle homolog 1
  Uniprot ID: Q96MT3
  ENSP ID: ENSP00000449819

SEQ ID NO: 66591 - protein, 844 aa, Homo sapiens
  Payload ID: 13272
  Gene Symbol: PRICKLE2
  Gene Name: prickle homolog 2
  Uniprot ID: Q7Z3G6
  ENSP ID: ENSP00000295902
MVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAGHGVCWHPPCFVCTVCNELLVDLIYFYQDGKIYCGRHHAECLKPRCAACDEIIFADECTEAEGRHWHMKHFCCFECETVLGGQRYIMKEGRPYCCHCFESLYAEYCDTCAQHIGIDQGQMTYDGQHWHATETCFCCAHCKKSLLGRPFLPKQGQIFCSRACSAGEDPNGSDSSDSAFQNARAKESRRSAKIGKNKGKTEEPMLNQHSQLQVSSNRLSADVDPLSLQMDMLSLSSQTPSLNRDPIWRSREEPYHYGNKMEQNQTQSPLQLLSQCNIRTSYSPGGQGAGAQPEMWGKHFSNPKRSSSLAMTGHAGSFIKECREDYYPGRLRSQESYSDMSSQSFSETRGSIQVPKYEEEEEEEGGLSTQQCRTRHPISSLKYTEDMTPTEQTPRGSMESLALSNATGLSADGGAKRQEHLSRFSMPDLSKDSGMNVSEKLSNMGTLNSSMQFRSAESVRSLLSAQQYQEMEGNLHQLSNPIGYRDLQSHGRMHQSFDFDGGMAGSKLPGQEGVRIQPMSERTRRRATSRDDNRRFRPHRSRRSRRSRSDNALHLASEREAISRLKDRPPLRAREDYDQFMRQRSFQESMGHGSRRDLYGQCPRTVSDLALQNAFGDRWGPYFAEYDWCSTCSSSSESDNEGYFLGEPIPQPARLRYVTSDELLHKYSSYGLPKSSTLGGRGQLHSRKRQKSKNCIIS

SEQ ID NO: 66592 - protein, 150 aa, Homo sapiens
  Payload ID: 13272
  Gene Symbol: PRICKLE2
  Gene Name: prickle homolog 2
  ENSP ID: ENSP00000419951
MVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAG

SEQ ID NO: 66593 - protein, 900 aa, Homo sapiens
  Payload ID: 13272
  Gene Symbol: PRICKLE2
  Gene Name: prickle homolog 2
  ENSP ID: ENSP00000455004
MFSRSSRKRLSSRSLTGLGRIERGQPCNACGDQCPGFALHKWRKICLHCKCPQEEHMVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAGHGVCWHPPCFVCTVCNELLVDLIYFYQDGKIYCGRHHAECLKPRCAACDEIIFADECTEAEGRHWHMKHFCCFECETVLGGQRYIMKEGRPYCCHCFESLYAEYCDTCAQHIGIDQGQMTYDGQHWHATETCFCCAHCKKSLLGRPFLPKQGQIFCSRACSAGEDPNGSDSSDSAFQNARAKESRRSAKIGKNKGKTEEPMLNQHSQLQVSSNRLSADVDPLSLQMDMLSLSSQTPSLNRDPIWRSREEPYHYGNKMEQNQTQSPLQLLSQCNIRTSYSPGGQGAGAQPEMWGKHFSNPKRSSSLAMTGHAGSFIKECREDYYPGRLRSQESYSDMSSQSFSETRGSIQVPKYEEEEEEEGGLSTQQCRTRHPISSLKYTEDMTPTEQTPRGSMESLALSNATGLSADGGAKRQEHLSRFSMPDLSKDSGMNVSEKLSNMGTLNSSMQFRSAESVRSLLSAQQYQEMEGNLHQLSNPIGYRDLQSHGRMHQSFDFDGGMAGSKLPGQEGVRIQPMSERTRRRATSRDDNRRFRPHRSRRSRRSRSDNALHLASEREAISRLKDRPPLRAREDYDQFMRQRSFQESMGHGSRRDLYGQCPRTVSDLALQNAFGDRWGPYFAEYDWCSTCSSSSESDNEGYFLGEPIPQPARLRYVTSDELLHKYSSYGLPKSSTLGGRGQLHSRKRQKSKNCIIS

SEQ ID NO: 66594 - protein, 140 aa, Homo sapiens
  Payload ID: 13272
  Gene Symbol: PRICKLE2
  Gene Name: prickle homolog 2
  ENSP ID: ENSP00000456173
MFSRSSRKRLSSRSVSVPRSSGADRRAPPAGRERPRAAPLRPAAAHLWPQLTGLGRIERGQPCNACGDQCPGFALHKWRKICLHCKCPQEEHMVTVMPLEMEKTISKLMFDFQRNSTSDDDSGCALEEYAWVPPGLKPEQ

SEQ ID NO: 66595 - protein, 114 aa, Homo sapiens
  Payload ID: 13273
  Gene Symbol: PRICKLE3
  Gene Name: prickle homolog 3
  ENSP ID: ENSP00000365494
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQLFSPTPMSSQ

SEQ ID NO: 66596 - protein, 547 aa, Homo sapiens
  Payload ID: 13273
  Gene Symbol: PRICKLE3
  Gene Name: prickle homolog 3
  ENSP ID: ENSP00000388599
MCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 66597 - protein, 251 aa, Homo sapiens
  Payload ID: 13273
  Gene Symbol: PRICKLE3
  Gene Name: prickle homolog 3
  ENSP ID: ENSP00000390620
MCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIG

SEQ ID NO: 66598 - protein, 98 aa, Homo sapiens
  Payload ID: 13273
  Gene Symbol: PRICKLE3
  Gene Name: prickle homolog 3
  ENSP ID: ENSP00000446051
MCRLISDFQRHSISDDDSGCASEEYAWVPPGLKPEQVTRGQPSTLAVQWVHTNAHTHTHTLRHSTAQHWKRRKRKSSEPLASSGSGRIWGVASCASSR

SEQ ID NO: 66599 - protein, 615 aa, Homo sapiens
  Payload ID: 13273
  Gene Symbol: PRICKLE3
  Gene Name: prickle homolog 3
  Uniprot ID: O43900
  ENSP ID: ENSP00000470248
MFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 66600 - protein, 384 aa, Homo sapiens
  Payload ID: 13274
  Gene Symbol: PRICKLE4
  Gene Name: prickle homolog 4
  Uniprot ID: Q2TBC4
  ENSP ID: ENSP00000335185
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 66601 - protein, 344 aa, Homo sapiens
  Payload ID: 13274
  Gene Symbol: PRICKLE4
  Gene Name: prickle homolog 4
  Uniprot ID: Q2TBC4
  ENSP ID: ENSP00000352128
MSPQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 66602 - protein, 312 aa, Homo sapiens
  Payload ID: 13274
  Gene Symbol: PRICKLE4
  Gene Name: prickle homolog 4
  ENSP ID: ENSP00000377802
MSPQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 66603 - protein, 344 aa, Homo sapiens; identical to SEQ ID NO: 66601
  Payload ID: 13274
  Gene Symbol: PRICKLE4
  Gene Name: prickle homolog 4
  ENSP ID: ENSP00000377803

SEQ ID NO: 66604 - protein, 384 aa, Homo sapiens; identical to SEQ ID NO: 66600
  Payload ID: 13274
  Gene Symbol: PRICKLE4
  Gene Name: prickle homolog 4
  ENSP ID: ENSP00000377806

SEQ ID NO: 66605 - protein, 70 aa, Homo sapiens
  Payload ID: 13274
  Gene Symbol: PRICKLE4
  Gene Name: prickle homolog 4
  ENSP ID: ENSP00000389023
MSVQNSGWPHQEDSPKPQDPGPPANSDSDSGHLPGEDPEDTHAQEFLSLHLLRTWGFDFKLIHMSIHYLS

SEQ ID NO: 66606 - protein, 384 aa, Homo sapiens; identical to SEQ ID NO: 66600
  Payload ID: 13274
  Gene Symbol: PRICKLE4
  Gene Name: prickle homolog 4
  Uniprot ID: Q2TBC4
  ENSP ID: ENSP00000404911

SEQ ID NO: 66607 - protein, 281 aa, Homo sapiens
  Payload ID: 13274
  Gene Symbol: PRICKLE4
  Gene Name: prickle homolog 4
  ENSP ID: ENSP00000489132
  MOD_RES (1)..(1): Any amino acid
XEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGKGEDAEQSGRELGLGCGGSPGLGPSPRSHAVPSLQERPHRTPQTQASGPAALTAHPWPERSKGRPNPPRAAVGVAAPDSLPGAGGGRPLVEAGDPGEDSRRRRRRARPRGWAGREAGPHPH

SEQ ID NO: 66608 - protein, 158 aa, Homo sapiens
  Payload ID: 13275
  Gene Symbol: PIFO
  Gene Name: primary cilia formation
  Uniprot ID: Q8TCI5
  ENSP ID: ENSP00000358752
MCFSRADAADNYPFGTCQQRKLFPHFHPPNLIGNKFVPLRGSPHRGPGCYFSDEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 66609 - protein, 191 aa, Homo sapiens
  Payload ID: 13275
  Gene Symbol: PIFO
  Gene Name: primary cilia formation
  Uniprot ID: Q8TCI5
  ENSP ID: ENSP00000358753
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 66610 - protein, 560 aa, Homo sapiens
  Payload ID: 13276
  Gene Symbol: PRIMPOL
  Gene Name: primase and polymerase (DNA-directed)
  Uniprot ID: Q96LW4
  ENSP ID: ENSP00000313816
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 66611 - protein, 560 aa, Homo sapiens; identical to SEQ ID NO: 66610
  Payload ID: 13276
  Gene Symbol: PRIMPOL
  Gene Name: primase and polymerase (DNA-directed)
  Uniprot ID: Q96LW4
  ENSP ID: ENSP00000420860

SEQ ID NO: 66612 - protein, 431 aa, Homo sapiens
  Payload ID: 13276
  Gene Symbol: PRIMPOL
  Gene Name: primase and polymerase (DNA-directed)
  ENSP ID: ENSP00000421913
MVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 66613 - protein, 112 aa, Homo sapiens
  Payload ID: 13276
  Gene Symbol: PRIMPOL
  Gene Name: primase and polymerase (DNA-directed)
  ENSP ID: ENSP00000422199
MNRKWEAKLKQIEERASHYERKPLSSVYRPRLSKPEEPPSIWRLFHRQAQAFNFVKSCKEDVHVFALECKVGDGQRIYLVTTYAEFWFYYKSSMCVKHFKSYTVLIAQLKMF

SEQ ID NO: 66614 - protein, 93 aa, Homo sapiens
  Payload ID: 13276
  Gene Symbol: PRIMPOL
  Gene Name: primase and polymerase (DNA-directed)
  ENSP ID: ENSP00000423353
MNRKWEAKLKQIEERASHYERKPLSSVYRPRLSKPEEPPSIWRLFHRQAQAFNFVKSCKEDVHVFALECKVGDGQRIYLVTTYAEFWFYYKSR

SEQ ID NO: 66615 - protein, 112 aa, Homo sapiens; identical to SEQ ID NO: 66613
  Payload ID: 13276
  Gene Symbol: PRIMPOL
  Gene Name: primase and polymerase (DNA-directed)
  ENSP ID: ENSP00000423409

SEQ ID NO: 66616 - protein, 172 aa, Homo sapiens
  Payload ID: 13276
  Gene Symbol: PRIMPOL
  Gene Name: primase and polymerase (DNA-directed)
  ENSP ID: ENSP00000424639
KLESVWLWRLLKITNFFLYSQKMFLTNINIFSLLWSAMSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKP

SEQ ID NO: 66617 - protein, 559 aa, Homo sapiens
  Payload ID: 13276
  Gene Symbol: PRIMPOL
  Gene Name: primase and polymerase (DNA-directed)
  ENSP ID: ENSP00000425316
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 66618 - protein, 420 aa, Homo sapiens
  Payload ID: 13277
  Gene Symbol: PRIM1
  Gene Name: primase, DNA, polypeptide 1 (49kDa)
  Uniprot ID: P49642
  ENSP ID: ENSP00000350491
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 66619 - protein, 185 aa, Homo sapiens
  Payload ID: 13277
  Gene Symbol: PRIM1
  Gene Name: primase, DNA, polypeptide 1 (49kDa)
  ENSP ID: ENSP00000448178
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKGKTLDLSIVSGYILEGEVFIVGSVMNQLENCLLQYVLG

SEQ ID NO: 66620 - protein, 152 aa, Homo sapiens
  Payload ID: 13277
  Gene Symbol: PRIM1
  Gene Name: primase, DNA, polypeptide 1 (49kDa)
  ENSP ID: ENSP00000449806
RKSINIIKKYFEEYALVNQDILENKESWDKILALVPEKSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENE

SEQ ID NO: 66621 - protein, 327 aa, Homo sapiens
  Payload ID: 13277
  Gene Symbol: PRIM1
  Gene Name: primase, DNA, polypeptide 1 (49kDa)
  ENSP ID: ENSP00000450185
METFDPTELPELLKLYYRRLFPYSQYYRWLNYGGGDGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVH

SEQ ID NO: 66622 - protein, 158 aa, Homo sapiens
  Payload ID: 13278
  Gene Symbol: PRIM2
  Gene Name: primase, DNA, polypeptide 2 (58kDa)
  Uniprot ID: P49643
  ENSP ID: ENSP00000483201
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAVSIFL

SEQ ID NO: 66623 - protein, 509 aa, Homo sapiens
  Payload ID: 13278
  Gene Symbol: PRIM2
  Gene Name: primase, DNA, polypeptide 2 (58kDa)
  Uniprot ID: P49643
  ENSP ID: ENSP00000484105
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTGQDYSTQGNVGKISLDQIDLLSTKSFPPCMRQLHKALRENHHLRHGGRMQYGLFLKGIGLTLEQALQFWKQEFIKGKMDPDKFDKGYSYNIRHSFGKEGKRTDYTPFSCLKIILSNPPSQGDYHGCPFRHSDPELLKQKLQSYKISPGGISQILDLVKGTHYQVACQKYFEMIHNVDDCGFSLNHPNQFFCESQRILNGGKDIKKEPIQPETPQPKPSVQKTKDASSALASLNSSLEMDMEGLEDYFSEDS

SEQ ID NO: 66624 - protein, 158 aa, Homo sapiens; identical to SEQ ID NO: 66622
  Payload ID: 13278
  Gene Symbol: PRIM2
  Gene Name: primase, DNA, polypeptide 2 (58kDa)
  Uniprot ID: P49643
  ENSP ID: ENSP00000485304

SEQ ID NO: 66625 - protein, 93 aa, Homo sapiens
  Payload ID: 13278
  Gene Symbol: PRIM2
  Gene Name: primase, DNA, polypeptide 2 (58kDa)
  ENSP ID: ENSP00000485395
  MOD_RES (1)..(1): Any amino acid
XHSYTGQDYSTQGNVGKISLDQIDLLSTKSFPPCMRQLHKALRENHHLRHGGRMQYGLFLKGIGLTLEQALQFWKQEFIKGKMDPDKEEENDE

SEQ ID NO: 66626 - protein, 253 aa, Homo sapiens
  Payload ID: 13279
  Gene Symbol: PRNP
  Gene Name: prion protein
  Uniprot ID: P04156
  ENSP ID: ENSP00000368752
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 66627 - protein, 253 aa, Homo sapiens; identical to SEQ ID NO: 66626
  Payload ID: 13279
  Gene Symbol: PRNP
  Gene Name: prion protein
  Uniprot ID: P04156
  ENSP ID: ENSP00000399376

SEQ ID NO: 66628 - protein, 249 aa, Homo sapiens
  Payload ID: 13279
  Gene Symbol: PRNP
  Gene Name: prion protein
  ENSP ID: ENSP00000411599
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIF

SEQ ID NO: 66629 - protein, 217 aa, Homo sapiens
  Payload ID: 13279
  Gene Symbol: PRNP
  Gene Name: prion protein
  ENSP ID: ENSP00000415284
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQ

SEQ ID NO: 66630 - protein, 94 aa, Homo sapiens
  Payload ID: 13280
  Gene Symbol: PRNT
  Gene Name: prion protein (testis specific)
  Uniprot ID: Q86SH4
  ENSP ID: ENSP00000321242
MQHSLVFFFAVILHLSHLLHLDASIHPFRLPFSSKPFLLIPMSNTTLPHTAWPLSFLHQTVSTLKAVAVTHSLWHLQIPVDCQACNRKSKKIYC

SEQ ID NO: 66631 - protein, 94 aa, Homo sapiens; identical to SEQ ID NO: 66630
  Payload ID: 13280
  Gene Symbol: PRNT
  Gene Name: prion protein (testis specific)
  Uniprot ID: Q86SH4
  ENSP ID: ENSP00000404306

SEQ ID NO: 66632 - protein, 94 aa, Homo sapiens; identical to SEQ ID NO: 66630
  Payload ID: 13280
  Gene Symbol: PRNT
  Gene Name: prion protein (testis specific)
  Uniprot ID: Q86SH4
  ENSP ID: ENSP00000409280

SEQ ID NO: 66633 - protein, 176 aa, Homo sapiens
  Payload ID: 13281
  Gene Symbol: PRND
  Gene Name: prion protein 2 (dublet)
  Uniprot ID: Q9UKY0
  ENSP ID: ENSP00000306900
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLTVK

SEQ ID NO: 66634 - protein, 340 aa, Homo sapiens
  Payload ID: 13282
  Gene Symbol: PAWR
  Gene Name: PRKC, apoptosis, WT1, regulator
  Uniprot ID: Q96IZ0
  ENSP ID: ENSP00000328088
MATGGYRTSSGLGGSTTDFLEEWKAKREKMRAKQNPPGPAPPGGGSSDAAGKPPAGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRDLDDIEDENEQLKQENKTLLKVVGQLTR

SEQ ID NO: 66635 - protein, 75 aa, Homo sapiens
  Payload ID: 13282
  Gene Symbol: PAWR
  Gene Name: PRKC, apoptosis, WT1, regulator
  ENSP ID: ENSP00000447454
MATGGYRTSSGLGGSTTDFLEEWKAKREKMRAKQNPPGPAPPGGGSSDAAGKPPAGALGTPAAAAANELNNNLPG

SEQ ID NO: 66636 - protein, 72 aa, Homo sapiens
  Payload ID: 13282
  Gene Symbol: PAWR
  Gene Name: PRKC, apoptosis, WT1, regulator
  ENSP ID: ENSP00000447507
KKIEDLEKEVVRERQENLRLVRLMQDKEEMIGKLKEEIDLLNRDLDDIEDENEQLKQENKTLLKVVGQLTSS

SEQ ID NO: 66637 - protein, 194 aa, Homo sapiens
  Payload ID: 13282
  Gene Symbol: PAWR
  Gene Name: PRKC, apoptosis, WT1, regulator
  ENSP ID: ENSP00000448317
  MOD_RES (1)..(1): Any amino acid
XGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKRKRDKPYTEQGAVTRSGSVGG

SEQ ID NO: 66638 - protein, 63 aa, Homo sapiens
  Payload ID: 13282
  Gene Symbol: PAWR
  Gene Name: PRKC, apoptosis, WT1, regulator
  ENSP ID: ENSP00000449928
MATGGYRTSSGLGGSTTDFLEEWKAKREKMRAKQNPPGPAPPGGGSSDAAGKPPAGALGTPAA

SEQ ID NO: 66639 - protein, 184 aa, Homo sapiens
  Payload ID: 13283
  Gene Symbol: PRKRIP1
  Gene Name: PRKR interacting protein 1 (IL11 inducible)
  Uniprot ID: Q9H875
  ENSP ID: ENSP00000381010
MASPAASSVRPPRPKKEPQTLVIPKNAAEEQKLKLERLMKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 66640 - protein, 184 aa, Homo sapiens; identical to SEQ ID NO: 66639
  Payload ID: 13283
  Gene Symbol: PRKRIP1
  Gene Name: PRKR interacting protein 1 (IL11 inducible)
  Uniprot ID: Q9H875
  ENSP ID: ENSP00000419270

SEQ ID NO: 66641 - protein, 127 aa, Homo sapiens
  Payload ID: 13283
  Gene Symbol: PRKRIP1
  Gene Name: PRKR interacting protein 1 (IL11 inducible)
  ENSP ID: ENSP00000420136
MEGEFPCQHSPGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 66642 - protein, 215 aa, Homo sapiens
  Payload ID: 13284
  Gene Symbol: PANO1
  Gene Name: proapoptotic nucleolar protein 1
  Uniprot ID: I0J062
  ENSP ID: ENSP00000479258
MGVRLRVWPAAPHSISRCPRPLGAVLSILLAGGSRKGTPTARCLGQRTKEKRVGGRSLRSEAGSGPCPTAGAQPTAPSSAWPPRLRPRTCPQMSGELPRVRPTRVGLSSLGSGPGHPPSGTRMCGERARNRRGRARRLTPEQPRIGASAGPGPPLPPARPRCSGSCHLPRPPQHLSPPQPGRVRMGAAEGSRRADTHHARRRRRARLPAPRSAST

SEQ ID NO: 66643 - protein, 449 aa, Homo sapiens
  Payload ID: 13285
  Gene Symbol: PCOLCE
  Gene Name: procollagen C-endopeptidase enhancer
  Uniprot ID: Q15113
  ENSP ID: ENSP00000223061
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGSISSEGNELLVQFVSDLSVTADGFSASYKTLPRGTAKEGQGPGPKRGTEPKVKLPPKSQPPEKTEESPSAPDAPTCPKQCRRTGTLQSNFCASSLVVTATVKSMVREPGEGLAVTVSLIGAYKTGGLDLPSPPTGASLKFYVPCKQCPPMKKGVSYLLMGQVEENRGPVLPPESFVVLHRPNQDQILTNLSKRKCPSQPVRAAASQD

SEQ ID NO: 66644 - protein, 415 aa, Homo sapiens
  Payload ID: 13286
  Gene Symbol: PCOLCE2
  Gene Name: procollagen C-endopeptidase enhancer 2
  Uniprot ID: Q9UKZ9
  ENSP ID: ENSP00000295992
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 66645 - protein, 101 aa, Homo sapiens
  Payload ID: 13286
  Gene Symbol: PCOLCE2
  Gene Name: procollagen C-endopeptidase enhancer 2
  ENSP ID: ENSP00000418782
  MOD_RES (1)..(1): Any amino acid
XGTFRPGALVSSGNKMMVQMISDANTAGNGFMAMFSAAEPNERGKKKKRGPESTSPLSRVAMLCQGISIVEDSLTDLPALLKPPTGQTGITLQESLVCGTL

SEQ ID NO: 66646 - protein, 140 aa, Homo sapiens
  Payload ID: 13286
  Gene Symbol: PCOLCE2
  Gene Name: procollagen C-endopeptidase enhancer 2
  ENSP ID: ENSP00000419643
TEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 66647 - protein, 303 aa, Homo sapiens
  Payload ID: 13286
  Gene Symbol: PCOLCE2
  Gene Name: procollagen C-endopeptidase enhancer 2
  ENSP ID: ENSP00000419842
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAISRHCYHNHHSRWEFARHSLDHQHLQRGKFGDSAGGQEHECQADCRLQAVPSPQKRSKLHYYGPSR

SEQ ID NO: 66648 - protein, 727 aa, Homo sapiens
  Payload ID: 13287
  Gene Symbol: PLOD1
  Gene Name: procollagen-lysine, 2-oxoglutarate 5-dioxygenase 1
  Uniprot ID: Q02809
  ENSP ID: ENSP00000196061
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 66649 - protein, 283 aa, Homo sapiens
  Payload ID: 13287
  Gene Symbol: PLOD1
  Gene Name: procollagen-lysine, 2-oxoglutarate 5-dioxygenase 1
  ENSP ID: ENSP00000405372
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALVSPWGQGHLPGACYELTASVLTSELSVMPSFPAVVLQLNYLGNYIPRFWTFETGCTVCDEGLRSLKGIG

SEQ ID NO: 66650 - protein, 225 aa, Homo sapiens
  Payload ID: 13287
  Gene Symbol: PLOD1
  Gene Name: procollagen-lysine, 2-oxoglutarate 5-dioxygenase 1
  ENSP ID: ENSP00000414443
MRPLLLLALLGWLLLAEAKGDAKPEAPCCQEGLRAGGSGSLHLGRDFTVLAGARGSPSPSVSSIPRFWIPGSDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDS

SEQ ID NO: 66651 - protein, 758 aa, Homo sapiens
  Payload ID: 13288
  Gene Symbol: PLOD2
  Gene Name: procollagen-lysine, 2-oxoglutarate 5-dioxygenase 2
  Uniprot ID: O00469
  ENSP ID: ENSP00000282903
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 66652 - protein, 737 aa, Homo sapiens
  Payload ID: 13288
  Gene Symbol: PLOD2
  Gene Name: procollagen-lysine, 2-oxoglutarate 5-dioxygenase 2
  Uniprot ID: O00469
  ENSP ID: ENSP00000353170
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 66653 - protein, 418 aa, Homo sapiens
  Payload ID: 13288
  Gene Symbol: PLOD2
  Gene Name: procollagen-lysine, 2-oxoglutarate 5-dioxygenase 2
  Uniprot ID: O00469
  ENSP ID: ENSP00000419354
MLENHILHKRIYILTFFSQQIFILCHAHFIFFFTVRDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 66654 - protein, 98 aa, Homo sapiens
  Payload ID: 13288
  Gene Symbol: PLOD2
  Gene Name: procollagen-lysine, 2-oxoglutarate 5-dioxygenase 2
  ENSP ID: ENSP00000419880
MGGCTVKPQLLLLALVLHPWNPCLGADSEKPSSIPTDKLLVITVATKESDGFHRFMQSAKYFNYTVKKEGSVSQVFSTNKRRTRRYLGPWSRRRMERW

SEQ ID NO: 66655 - protein, 229 aa, Homo sapiens
  Payload ID: 13288
  Gene Symbol: PLOD2
  Gene Name: procollagen-lysine, 2-oxoglutarate 5-dioxygenase 2
  ENSP ID: ENSP00000419963
MTRFGVRLYKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGP

SEQ ID NO: 66656 - protein, 703 aa, Homo sapiens
  Payload ID: 13288
  Gene Symbol: PLOD2
  Gene Name: procollagen-lysine, 2-oxoglutarate 5-dioxygenase 2
  ENSP ID: ENSP00000420094
MQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 66657 - protein, 738 aa, Homo sapiens
  Payload ID: 13289
  Gene Symbol: PLOD3
  Gene Name: procollagen-lysine, 2-oxoglutarate 5-dioxygenase 3
  Uniprot ID: O60568
  ENSP ID: ENSP00000223127
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 66658 - protein, 66 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000394045
  MOD_RES (1)..(1): Any amino acid
XFSLDADAVLTNLQTLRILIEENRKVIAPMLSRHGKLWSNFWGALSPDEYYARSEDYVELVQRKRV

SEQ ID NO: 66659 - protein, 125 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000404799
TLGLGEEWRGGDVARTVGGGQKVRWLKKEMEKYADREDMIIMFVDSYDVILAGSPTELLKKFVQSGSRLLFSAESFCWPEWGLAEQYPEDSSVLPPPSTKSCASGSTRMMTTTSCSTHGSTWTQD

SEQ ID NO: 66660 - protein, 171 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000407551
MGHFKDVVTVFLQEILFSFGPCEDAVITKAAPGASPGRRGEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSG

SEQ ID NO: 66661 - protein, 264 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000407555
  MOD_RES (1)..(1): Any amino acid
XNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 66662 - protein, 270 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000407908
  MOD_RES (1)..(1): Any amino acid
XFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQR

SEQ ID NO: 66663 - protein, 75 aa, Homo sapiens
  Payload ID: 13289
  Gene Symbol: PLOD3
  Gene Name: procollagen-lysine, 2-oxoglutarate 5-dioxygenase 3
  ENSP ID: ENSP00000416070
MTSSGPGPRFLLLLPLLLPPAASASDRPRGRDPVNPEKLLVITVATAETEGYLRFLRSAEFFNYTVRTLGLGEEW

SEQ ID NO: 66664 - protein, 254 aa, Homo sapiens [sequence omitted]

SEQ ID NO: 66665 - protein, 254 aa, Homo sapiens [sequence omitted]

SEQ ID NO: 66666 - protein, 254 aa, Homo sapiens [sequence omitted]

SEQ ID NO: 66667 - protein, 267 aa, Homo sapiens
  Payload ID: 13291
  Gene Symbol: PENK
  Gene Name: proenkephalin
  Uniprot ID: P01210
  ENSP ID: ENSP00000324248
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 66668 - protein, 267 aa, Homo sapiens; identical to SEQ ID NO: 66667
  Payload ID: 13291
  Gene Symbol: PENK
  Gene Name: proenkephalin
  Uniprot ID: P01210
  ENSP ID: ENSP00000400894

SEQ ID NO: 66669 - protein, 105 aa, Homo sapiens
  Payload ID: 13291
  Gene Symbol: PENK
  Gene Name: proenkephalin
  ENSP ID: ENSP00000428012
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMK

SEQ ID NO: 66670 - protein, 79 aa, Homo sapiens
  Payload ID: 13291
  Gene Symbol: PENK
  Gene Name: proenkephalin
  ENSP ID: ENSP00000429326
MARFLTLCTWLLLLGPGLLATVRAECSQDCATCSYRLVRPADINFLDCGGGEEEGCSFQNFPYCFLCSCCYHLLLLSLL

SEQ ID NO: 66671 - protein, 88 aa, Homo sapiens
  Payload ID: 13291
  Gene Symbol: PENK
  Gene Name: proenkephalin
  ENSP ID: ENSP00000430268
FLTLCTWLLLLGPGLLATVRAECSQDCATCSYRLVRPADINFLKHPRIDQFIHSTNEYLMEEAPDGGKSQCNASKWRHGVLMEKQQDL

SEQ ID NO: 66672 - protein, 92 aa, Homo sapiens
  Payload ID: 13291
  Gene Symbol: PENK
  Gene Name: proenkephalin
  ENSP ID: ENSP00000430592
MARFLTLCTWLLLLGPGLLATVRAECSQDCATCSYRLVRPADINFLVSVARGECCAPCETEFPQQYADCLRPTARRVWRFAPGRSRSGASPW

SEQ ID NO: 66673 - protein, 140 aa, Homo sapiens
  Payload ID: 13292
  Gene Symbol: PFN1
  Gene Name: profilin 1
  Uniprot ID: P07737
  ENSP ID: ENSP00000225655
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 66674 - protein, 165 aa, Homo sapiens
  Payload ID: 13292
  Gene Symbol: PFN1
  Gene Name: profilin 1
  ENSP ID: ENSP00000460363
MHSRPRRRRRRGHTRRRPPVLPFGGGSGGARAAAQRAEPRSGRQRVPRALRLPPPASRGSSSPVRGPSSSAESSPSSSAMAGWNAYIDNLMADGTCQDAAIVGYKDSPSVWAAVPGKTFVNITPAEVGVLVGKDRSSFYVNGLTLGGQKCSVIRDSLLQDGEFSM

SEQ ID NO: 66675 - protein, 104 aa, Homo sapiens
  Payload ID: 13292
  Gene Symbol: PFN1
  Gene Name: profilin 1
  ENSP ID: ENSP00000465019
MGAWFLFQPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 66676 - protein, 140 aa, Homo sapiens
  Payload ID: 13293
  Gene Symbol: PFN2
  Gene Name: profilin 2
  Uniprot ID: P35080
  ENSP ID: ENSP00000239940
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 66677 - protein, 188 aa, Homo sapiens
  Payload ID: 13293
  Gene Symbol: PFN2
  Gene Name: profilin 2
  ENSP ID: ENSP00000408283
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRYPNITIWSVSSLFFIGPIFICSLSFYMKLHYCGLGCLVMNFFHMYSVPYYC

SEQ ID NO: 66678 - protein, 140 aa, Homo sapiens
  Payload ID: 13293
  Gene Symbol: PFN2
  Gene Name: profilin 2
  Uniprot ID: P35080
  ENSP ID: ENSP00000410464
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 66679 - protein, 125 aa, Homo sapiens
  Payload ID: 13293
  Gene Symbol: PFN2
  Gene Name: profilin 2
  ENSP ID: ENSP00000417351
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQVLVFVMGKEGVHGGGLNKKAYSMAKYLRDSGF

SEQ ID NO: 66680 - protein, 91 aa, Homo sapiens
  Payload ID: 13293
  Gene Symbol: PFN2
  Gene Name: profilin 2
  ENSP ID: ENSP00000417817
MIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 66681 - protein, 45 aa, Homo sapiens
  Payload ID: 13293
  Gene Symbol: PFN2
  Gene Name: profilin 2
  ENSP ID: ENSP00000417912
MAGWQSYVDNLMCDGCCQEAAIVGYCDAKYVWAATAGGVFQSITK

SEQ ID NO: 66682 - protein, 45 aa, Homo sapiens; identical to SEQ ID NO: 66681
  Payload ID: 13293
  Gene Symbol: PFN2
  Gene Name: profilin 2
  ENSP ID: ENSP00000417924

SEQ ID NO: 66683 - protein, 91 aa, Homo sapiens; identical to SEQ ID NO: 66680
  Payload ID: 13293
  Gene Symbol: PFN2
  Gene Name: profilin 2
  ENSP ID: ENSP00000418142

SEQ ID NO: 66684 - protein, 91 aa, Homo sapiens; identical to SEQ ID NO: 66680
  Payload ID: 13293
  Gene Symbol: PFN2
  Gene Name: profilin 2
  ENSP ID: ENSP00000418216

SEQ ID NO: 66685 - protein, 55 aa, Homo sapiens
  Payload ID: 13293
  Gene Symbol: PFN2
  Gene Name: profilin 2
  ENSP ID: ENSP00000418494
MAGWQSYVDNLMCDGCCQEAAIVGYCDAKYVWAATAGGVFQSITEKTGKVSLPTV

SEQ ID NO: 66686 - protein, 55 aa, Homo sapiens; identical to SEQ ID NO: 66685
  Payload ID: 13293
  Gene Symbol: PFN2
  Gene Name: profilin 2
  ENSP ID: ENSP00000418521

SEQ ID NO: 66687 - protein, 91 aa, Homo sapiens
  Payload ID: 13293
  Gene Symbol: PFN2
  Gene Name: profilin 2
  ENSP ID: ENSP00000418523
MIVGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 66688 - protein, 91 aa, Homo sapiens; identical to SEQ ID NO: 66680
  Payload ID: 13293
  Gene Symbol: PFN2
  Gene Name: profilin 2
  ENSP ID: ENSP00000420202

SEQ ID NO: 66689 - protein, 110 aa, Homo sapiens
  Payload ID: 13293
  Gene Symbol: PFN2
  Gene Name: profilin 2
  ENSP ID: ENSP00000420244
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRGE

SEQ ID NO: 66690 - protein, 91 aa, Homo sapiens; identical to SEQ ID NO: 66687
  Payload ID: 13293
  Gene Symbol: PFN2
  Gene Name: profilin 2
  ENSP ID: ENSP00000420417

SEQ ID NO: 66691 - protein, 91 aa, Homo sapiens; identical to SEQ ID NO: 66680
  Payload ID: 13293
  Gene Symbol: PFN2
  Gene Name: profilin 2
  ENSP ID: ENSP00000420504

SEQ ID NO: 66692 - protein, 137 aa, Homo sapiens
  Payload ID: 13294
  Gene Symbol: PFN3
  Gene Name: profilin 3
  Uniprot ID: P60673
  ENSP ID: ENSP00000351379
MGDWKVYISAVLRDQRIDDVAIVGHADNSCVWASRPGGLLAAISPQEVGVLTGPDRHTFLQAGLSVGGRRCCVIRDHLLAEGDGVLDARTKGLDARAVCVGRAPRALLVLMGRRGVHGGILNKTVHELIRGLRMQGA

SEQ ID NO: 66693 - protein, 129 aa, Homo sapiens
  Payload ID: 13295
  Gene Symbol: PFN4
  Gene Name: profilin family, member 4
  Uniprot ID: Q8NHR9
  ENSP ID: ENSP00000322170
MSHLQSLLLDTLLGTKHVDSAALIKIQERSLCVASPGFNVTPSDVRTLVNGFAKNPLQARREGLYFKGKDYRCVRADEYSLYAKNENTGVVVVKTHLYLLVATYTEGMYPSICVEATESLGDYLRKKGS

SEQ ID NO: 66694 - protein, 9 aa, Homo sapiens
  Payload ID: 13295
  Gene Symbol: PFN4
  Gene Name: profilin family, member 4
  ENSP ID: ENSP00000393504
MSHLQSLLL

SEQ ID NO: 66695 - protein, 139 aa, Homo sapiens
  Payload ID: 13296
  Gene Symbol: PGC
  Gene Name: progastricsin (pepsinogen C)
  ENSP ID: ENSP00000349094
MKWMVVVLVCLQLLEAAVVKVPLKKFKSIRETMKEKGLLGEFLRTHKYDPAWKYRFGDLSVTYEPMAYMDVQSIQVPNQEFGLSENEPGTNFVYAQFDGIMGLAYPALSVDEATTAMQGMVQEGALTSPVFSVYLSNQQ

SEQ ID NO: 66696 - protein, 388 aa, Homo sapiens
  Payload ID: 13296
  Gene Symbol: PGC
  Gene Name: progastricsin (pepsinogen C)
  Uniprot ID: P20142
  ENSP ID: ENSP00000362116
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIEEFLIGGQASGWCSEGCQAIVDTGTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 66697 - protein, 86 aa, Homo sapiens
  Payload ID: 13296
  Gene Symbol: PGC
  Gene Name: progastricsin (pepsinogen C)
  ENSP ID: ENSP00000399429
MCLHPSSTPPFHQPRKEAVICKQRVPLKKFKSIRETMKEKGLLGEFLRTHKYDPAWKYRFGDLSVTYEPMAYMDAAYFGEISIGTP

SEQ ID NO: 66698 - protein, 315 aa, Homo sapiens
  Payload ID: 13296
  Gene Symbol: PGC
  Gene Name: progastricsin (pepsinogen C)
  Uniprot ID: P20142
  ENSP ID: ENSP00000405094
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNLVLESSGLGPLLTPSRAAPPSSTLQLPEKPLEQTWNILTPFTKTLPVSNLSRKVTSWAGVGIPVTCLPEAGSGGERRAECGLGVPTTRGPPRSQHHSGA

SEQ ID NO: 66699 - protein, 180 aa, Homo sapiens
  Payload ID: 13297
  Gene Symbol: PAEP
  Gene Name: progestagen-associated endometrial protein
  Uniprot ID: P09466
  ENSP ID: ENSP00000277508
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 66700 - protein, 180 aa, Homo sapiens; identical to SEQ ID NO: 66699
  Payload ID: 13297
  Gene Symbol: PAEP
  Gene Name: progestagen-associated endometrial protein
  Uniprot ID: P09466
  ENSP ID: ENSP00000360831

SEQ ID NO: 66701 - protein, 131 aa, Homo sapiens
  Payload ID: 13297
  Gene Symbol: PAEP
  Gene Name: progestagen-associated endometrial protein
  ENSP ID: ENSP00000394216
  MOD_RES (1)..(1): Any amino acid
XVPAMDIPQTKQDLELPKAPLRVHITSLLPTPEDNLEIVLHRWENNSCVEKKVLGEKTENPKKFKINCKASGAPQLSWKPQGPRTDPASSTARVLVEDDEIMQGFIRAFRPLPRHLWYLLDLKQMEEPCRF

SEQ ID NO: 66702 - protein, 33 aa, Homo sapiens
  Payload ID: 13297
  Gene Symbol: PAEP
  Gene Name: progestagen-associated endometrial protein
  ENSP ID: ENSP00000396196
  MOD_RES (1)..(1): Any amino acid
XEIMQGFIRAFRPLPRHLWYLLDLKQMEEPCRF

SEQ ID NO: 66703 - protein, 132 aa, Homo sapiens
  Payload ID: 13297
  Gene Symbol: PAEP
  Gene Name: progestagen-associated endometrial protein
  ENSP ID: ENSP00000401933
LMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 66704 - protein, 126 aa, Homo sapiens
  Payload ID: 13297
  Gene Symbol: PAEP
  Gene Name: progestagen-associated endometrial protein
  ENSP ID: ENSP00000404033
  MOD_RES (1)..(1): Any amino acid
XPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 66705 - protein, 180 aa, Homo sapiens; identical to SEQ ID NO: 66699
  Payload ID: 13297
  Gene Symbol: PAEP
  Gene Name: progestagen-associated endometrial protein
  Uniprot ID: P09466
  ENSP ID: ENSP00000417898

SEQ ID NO: 66706 - protein, 169 aa, Homo sapiens
  Payload ID: 13297
  Gene Symbol: PAEP
  Gene Name: progestagen-associated endometrial protein
  ENSP ID: ENSP00000431712
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLESWWRTMRSCRDSSGLSGPCPGTYGTCWT

SEQ ID NO: 66707 - protein, 143 aa, Homo sapiens
  Payload ID: 13297
  Gene Symbol: PAEP
  Gene Name: progestagen-associated endometrial protein
  ENSP ID: ENSP00000484659
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINSRVLVEDDEIMQGFIRAFRPLPRHLWYLLDLKQMEEPCRF

SEQ ID NO: 66708 - protein, 757 aa, Homo sapiens
  Payload ID: 13298
  Gene Symbol: PIBF1
  Gene Name: progesterone immunomodulatory binding factor 1
  Uniprot ID: Q8WXW3
  ENSP ID: ENSP00000317144
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 66709 - protein, 698 aa, Homo sapiens
  Payload ID: 13298
  Gene Symbol: PIBF1
  Gene Name: progesterone immunomodulatory binding factor 1
  ENSP ID: ENSP00000478697
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREVFFLFCHNCNHFRLF

SEQ ID NO: 66710 - protein, 216 aa, Homo sapiens
  Payload ID: 13298
  Gene Symbol: PIBF1
  Gene Name: progesterone immunomodulatory binding factor 1
  Uniprot ID: Q8WXW3
  ENSP ID: ENSP00000483286
MQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 66711 - protein, 831 aa, Homo sapiens
  Payload ID: 13299
  Gene Symbol: PGR
  Gene Name: progesterone receptor
  Uniprot ID: P06401
  ENSP ID: ENSP00000263463
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 66712 - protein, 933 aa, Homo sapiens
  Payload ID: 13299
  Gene Symbol: PGR
  Gene Name: progesterone receptor
  Uniprot ID: P06401
  ENSP ID: ENSP00000325120
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 66713 - protein, 803 aa, Homo sapiens
  Payload ID: 13299
  Gene Symbol: PGR
  Gene Name: progesterone receptor
  ENSP ID: ENSP00000432352
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 66714 - protein, 764 aa, Homo sapiens
  Payload ID: 13299
  Gene Symbol: PGR
  Gene Name: progesterone receptor
  ENSP ID: ENSP00000432914
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 66715 - protein, 339 aa, Homo sapiens
  Payload ID: 13299
  Gene Symbol: PGR
  Gene Name: progesterone receptor
  Uniprot ID: P06401
  ENSP ID: ENSP00000436561
MEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 66716 - protein, 695 aa, Homo sapiens
  Payload ID: 13299
  Gene Symbol: PGR
  Gene Name: progesterone receptor
  ENSP ID: ENSP00000436803
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNDSFGRATKSNPV

SEQ ID NO: 66717 - protein, 690 aa, Homo sapiens [sequence omitted]

SEQ ID NO: 66718 - protein, 764 aa, Homo sapiens; identical to SEQ ID NO: 66714
  Payload ID: 13299
  Gene Symbol: PGR
  Gene Name: progesterone receptor
  ENSP ID: ENSP00000482698

SEQ ID NO: 66719 - protein, 170 aa, Homo sapiens
  Payload ID: 13299
  Gene Symbol: PGR
  Gene Name: progesterone receptor
  ENSP ID: ENSP00000487607
MKCFFLRRRTFTRSACLGEEPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEP

SEQ ID NO: 66720 - protein, 195 aa, Homo sapiens
  Payload ID: 13300
  Gene Symbol: PGRMC1
  Gene Name: progesterone receptor membrane component 1
  Uniprot ID: O00264
  ENSP ID: ENSP00000217971
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 66721 - protein, 143 aa, Homo sapiens
  Payload ID: 13300
  Gene Symbol: PGRMC1
  Gene Name: progesterone receptor membrane component 1
  Uniprot ID: O00264
  ENSP ID: ENSP00000442821
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPVKYHHVGKLLKEGEEPTVYSDEEEPKDESARKND

SEQ ID NO: 66722 - protein, 223 aa, Homo sapiens
  Payload ID: 13301
  Gene Symbol: PGRMC2
  Gene Name: progesterone receptor membrane component 2
  Uniprot ID: O15173
  ENSP ID: ENSP00000296425
MAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 66723 - protein, 247 aa, Homo sapiens
  Payload ID: 13301
  Gene Symbol: PGRMC2
  Gene Name: progesterone receptor membrane component 2
  Uniprot ID: O15173
  ENSP ID: ENSP00000429301
MGGAGRGVGEGRGRGGGGRRWRAVMAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 66724 - protein, 44 aa, Homo sapiens
  Payload ID: 13301
  Gene Symbol: PGRMC2
  Gene Name: progesterone receptor membrane component 2
  ENSP ID: ENSP00000475242
MESVREWEMQFKEKYDYVGRLLKPGEEPSEYTDEEDTKDHNKQD

SEQ ID NO: 66725 - protein, 44 aa, Homo sapiens; identical to SEQ ID NO: 66724
  Payload ID: 13301
  Gene Symbol: PGRMC2
  Gene Name: progesterone receptor membrane component 2
  ENSP ID: ENSP00000475268

SEQ ID NO: 66726 - protein, 44 aa, Homo sapiens; identical to SEQ ID NO: 66724
  Payload ID: 13301
  Gene Symbol: PGRMC2
  Gene Name: progesterone receptor membrane component 2
  ENSP ID: ENSP00000475350

SEQ ID NO: 66727 - protein, 59 aa, Homo sapiens
  Payload ID: 13301
  Gene Symbol: PGRMC2
  Gene Name: progesterone receptor membrane component 2
  ENSP ID: ENSP00000475603
KFYGPGEELEGEGKDPLQLKHNPLRTGRPLGTGPRLGACKVPTLQSLKSRRISNTSDSL

SEQ ID NO: 66728 - protein, 91 aa, Homo sapiens
  Payload ID: 13301
  Gene Symbol: PGRMC2
  Gene Name: progesterone receptor membrane component 2
  ENSP ID: ENSP00000476010
MQSLLKTAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 66729 - protein, 247 aa, Homo sapiens; identical to SEQ ID NO: 66723
  Payload ID: 13301
  Gene Symbol: PGRMC2
  Gene Name: progesterone receptor membrane component 2
  Uniprot ID: O15173
  ENSP ID: ENSP00000481886

SEQ ID NO: 66730 - protein, 291 aa, Homo sapiens
  Payload ID: 13302
  Gene Symbol: PAQR3
  Gene Name: progestin and adipoQ receptor family member III
  ENSP ID: ENSP00000344203
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPENIFRWKITKRTLGGVNNSLQNLYLLV

SEQ ID NO: 66731 - protein, 269 aa, Homo sapiens
  Payload ID: 13302
  Gene Symbol: PAQR3
  Gene Name: progestin and adipoQ receptor family member III
  Uniprot ID: Q6TCH7
  ENSP ID: ENSP00000378959
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPESLPR

SEQ ID NO: 66732 - protein, 68 aa, Homo sapiens
  Payload ID: 13302
  Gene Symbol: PAQR3
  Gene Name: progestin and adipoQ receptor family member III
  ENSP ID: ENSP00000420848
MHQKLLKSAHYIELGSYQYWPVLVPRGIRLYTYEQIPGSLKDNPYITDGYRAYLPSRLCIKRHYTRHR

SEQ ID NO: 66733 - protein, 311 aa, Homo sapiens
  Payload ID: 13302
  Gene Symbol: PAQR3
  Gene Name: progestin and adipoQ receptor family member III
  Uniprot ID: Q6TCH7
  ENSP ID: ENSP00000421981
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPGQLNYLGSSHQIWHILAVVMLYWWHQSTVYVMQYRHSKPCPDYVSHL

SEQ ID NO: 66734 - protein, 88 aa, Homo sapiens
  Payload ID: 13302
  Gene Symbol: PAQR3
  Gene Name: progestin and adipoQ receptor family member III
  Uniprot ID: Q6TCH7
  ENSP ID: ENSP00000422357
MHQKLLKSAHYIELGSYQYWPVLVPRGIRLYTYEQIPGSLKDNPYITDGYRAYLPSRLCIKRSVCFALWAIIFFPAIGQKKHVEDGWH

SEQ ID NO: 66735 - protein, 311 aa, Homo sapiens; identical to SEQ ID NO: 66733
  Payload ID: 13302
  Gene Symbol: PAQR3
  Gene Name: progestin and adipoQ receptor family member III
  Uniprot ID: Q6TCH7
  ENSP ID: ENSP00000425080

SEQ ID NO: 66736 - protein, 88 aa, Homo sapiens; identical to SEQ ID NO: 66734
  Payload ID: 13302
  Gene Symbol: PAQR3
  Gene Name: progestin and adipoQ receptor family member III
  Uniprot ID: Q6TCH7
  ENSP ID: ENSP00000426875

SEQ ID NO: 66737 - protein, 234 aa, Homo sapiens
  Payload ID: 13303
  Gene Symbol: PAQR4
  Gene Name: progestin and adipoQ receptor family member IV
  Uniprot ID: Q8N4S7
  ENSP ID: ENSP00000293978
MAFLAGPRLLDWASSPPHLQFNKFVLTGYRPASSGSGCLRSLFYLHNELGNIYTHGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 66738 - protein, 273 aa, Homo sapiens
  Payload ID: 13303
  Gene Symbol: PAQR4
  Gene Name: progestin and adipoQ receptor family member IV
  Uniprot ID: Q8N4S7
  ENSP ID: ENSP00000321804
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 66739 - protein, 206 aa, Homo sapiens
  Payload ID: 13303
  Gene Symbol: PAQR4
  Gene Name: progestin and adipoQ receptor family member IV
  ENSP ID: ENSP00000458683
MTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 66740 - protein, 199 aa, Homo sapiens
  Payload ID: 13303
  Gene Symbol: PAQR4
  Gene Name: progestin and adipoQ receptor family member IV
  ENSP ID: ENSP00000459418
MAFLAGPRLLDWASSPPHLQFNKFVLTGYRPASSGSGCLRSLFYLHNELGNIYTHGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 66741 - protein, 206 aa, Homo sapiens; identical to SEQ ID NO: 66739
  Payload ID: 13303
  Gene Symbol: PAQR4
  Gene Name: progestin and adipoQ receptor family member IV
  ENSP ID: ENSP00000460326

SEQ ID NO: 66742 - protein, 377 aa, Homo sapiens
  Payload ID: 13304
  Gene Symbol: PAQR9
  Gene Name: progestin and adipoQ receptor family member IX
  Uniprot ID: Q6ZVX9
  ENSP ID: ENSP00000341564
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFLSGGDVPFHHPWLLPLWCYASGVLLTFAMSCTAHVFSCLSLRLRAAFFYLDYASISYYGFGSTVAYYYYLLPGLSLLDARVMTPYLQQRLGWHVDCTRLIAAYRALVLPVAFVLAVACTVACCKSRTDWCTYPFALRTFVFVMPLSMACPIMLESWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKK

SEQ ID NO: 66743 - protein, 146 aa, Homo sapiens
  Payload ID: 13304
  Gene Symbol: PAQR9
  Gene Name: progestin and adipoQ receptor family member IX
  ENSP ID: ENSP00000417945
  MOD_RES (1)..(1): Any amino acid
XSWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKKFCQGDKSRKIGLEQKAAEGSSSEGSHFL

SEQ ID NO: 66744 - protein, 38 aa, Homo sapiens
  Payload ID: 13304
  Gene Symbol: PAQR9
  Gene Name: progestin and adipoQ receptor family member IX
  ENSP ID: ENSP00000420737
VIRKFLNSSEFCSKKFCQGDKSRKIGLEQKAAEGSLLC

SEQ ID NO: 66745 - protein, 330 aa, Homo sapiens
  Payload ID: 13305
  Gene Symbol: PAQR5
  Gene Name: progestin and adipoQ receptor family member V
  Uniprot ID: Q9NXK6
  ENSP ID: ENSP00000343877
MLSLKLPRLFSIDQIPQVFHEQGILFGYRHPQSSATACILSLFQMTNETLNIWTHLLPFWFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSRFLEIQKPRLCKVIRVLAFAYPYTWDSLPIFYRLFLFPGESAQNEATSYHQKHMIMTLLASFLYSAHLPERLAPGRFDYIGHSHQLFHVCVILATHMQMEAILLDKTLRKEWLLATSKPFSFSQIAGAILLCIIFSLSNIIYFSAALYRIPKPELHKKET

SEQ ID NO: 66746 - protein, 330 aa, Homo sapiens; identical to SEQ ID NO: 66745
  Payload ID: 13305
  Gene Symbol: PAQR5
  Gene Name: progestin and adipoQ receptor family member V
  Uniprot ID: Q9NXK6
  ENSP ID: ENSP00000378803

SEQ ID NO: 66747 - protein, 127 aa, Homo sapiens
  Payload ID: 13305
  Gene Symbol: PAQR5
  Gene Name: progestin and adipoQ receptor family member V
  ENSP ID: ENSP00000453009
MTNETLNIWTHLLPFWFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSR

SEQ ID NO: 66748 - protein, 330 aa, Homo sapiens; identical to SEQ ID NO: 66745
  Payload ID: 13305
  Gene Symbol: PAQR5
  Gene Name: progestin and adipoQ receptor family member V
  Uniprot ID: Q9NXK6
  ENSP ID: ENSP00000453526

SEQ ID NO: 66749 - protein, 344 aa, Homo sapiens
  Payload ID: 13306
  Gene Symbol: PAQR6
  Gene Name: progestin and adipoQ receptor family member VI
  Uniprot ID: Q6TCH4
  ENSP ID: ENSP00000292291
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 66750 - protein, 351 aa, Homo sapiens
  Payload ID: 13306
  Gene Symbol: PAQR6
  Gene Name: progestin and adipoQ receptor family member VI
  Uniprot ID: Q6TCH4
  ENSP ID: ENSP00000338330
MSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 66751 - protein, 363 aa, Homo sapiens
  Payload ID: 13306
  Gene Symbol: PAQR6
  Gene Name: progestin and adipoQ receptor family member VI
  ENSP ID: ENSP00000341926
TLPPSAWLAAALDSARGALGLLTHQLRSTHQALGVLGRWHHVWLPPPHQLGFGLCPQLLPDDQRDGQHLDSLPAHLVRGGSAPGRGLELRGGTQAGRDRPGPRAAAAVAGVRGGLSTRPPQVLPVAAPGAGGRPRLPCGAVPLAAAGLPAARLPLPLRVVLRAHLQLHVAPHAPHLLLPRLRRAQPLQSGFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 66752 - protein, 341 aa, Homo sapiens
  Payload ID: 13306
  Gene Symbol: PAQR6
  Gene Name: progestin and adipoQ receptor family member VI
  Uniprot ID: Q6TCH4
  ENSP ID: ENSP00000349474
MLSLKLPQLLQVHQVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 66753 - protein, 320 aa, Homo sapiens
  Payload ID: 13306
  Gene Symbol: PAQR6
  Gene Name: progestin and adipoQ receptor family member VI
  Uniprot ID: Q6TCH4
  ENSP ID: ENSP00000357253
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 66754 - protein, 211 aa, Homo sapiens
  Payload ID: 13306
  Gene Symbol: PAQR6
  Gene Name: progestin and adipoQ receptor family member VI
  ENSP ID: ENSP00000443167
MATISSARCSLASSSPPTCLKGWHQDALITSATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 66755 - protein, 211 aa, Homo sapiens; identical to SEQ ID NO: 66754
  Payload ID: 13306
  Gene Symbol: PAQR6
  Gene Name: progestin and adipoQ receptor family member VI
  ENSP ID: ENSP00000479864

SEQ ID NO: 66756 - protein, 283 aa, Homo sapiens
  Payload ID: 13306
  Gene Symbol: PAQR6
  Gene Name: progestin and adipoQ receptor family member VI
  ENSP ID: ENSP00000482685
MPPTPCRPPGCTATCTSSLCLPPHSTPSCAPASPATPVSWSWKALGSVRSSAQEPSPIHSCSTTSHSFIGLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 66757 - protein, 211 aa, Homo sapiens; identical to SEQ ID NO: 66754
  Payload ID: 13306
  Gene Symbol: PAQR6
  Gene Name: progestin and adipoQ receptor family member VI
  ENSP ID: ENSP00000485607

SEQ ID NO: 66758 - protein, 346 aa, Homo sapiens
  Payload ID: 13307
  Gene Symbol: PAQR7
  Gene Name: progestin and adipoQ receptor family member VII
  Uniprot ID: Q86WK9
  ENSP ID: ENSP00000363414
MAMAQKLSHLLPSLRQVIQEPQLSLQPEPVFTVDRAEVPPLFWKPYIYAGYRPLHQTWRFYFRTLFQQHNEAVNVWTHLLAALVLLLRLALFVETVDFWGDPHALPLFIIVLASFTYLSFSALAHLLQAKSEFWHYSFFFLDYVGVAVYQFGSALAHFYYAIEPAWHAQVQAVFLPMAAFLAWLSCIGSCYNKYIQKPGLLGRTCQEVPSVLAYALDISPVVHRIFVSSDPTTDDPALLYHKCQVVFFLLAAAFFSTFMPERWFPGSCHVFGQGHQLFHIFLVLCTLAQLEAVALDYEARRPIYEPLHTHWPHNFSGLFLLTVGSSILTAFLLSQLVQRKLDQKTK

SEQ ID NO: 66759 - protein, 354 aa, Homo sapiens
  Payload ID: 13308
  Gene Symbol: PAQR8
  Gene Name: progestin and adipoQ receptor family member VIII
  Uniprot ID: Q8TEZ7
  ENSP ID: ENSP00000353953
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPLLLFILSSITYLTCSLLAHLLQSKSELSHYTFYFVDYVGVSVYQYGSALAHFFYSSDQAWYDRFWLFFLPAAAFCGWLSCAGCCYAKYRYRRPYPVMRKICQVVPAGLAFILDISPVAHRVALCHLAGCQEQAAWYHTLQILFFLVSAYFFSCPVPEKYFPGSCDIVGHGHQIFHAFLSICTLSQLEAILLDYQGRQEIFLQRHGPLSVHMACLSFFFLAACSAATAALLRHKVKARLTKKDS

SEQ ID NO: 66760 - protein, 354 aa, Homo sapiens; identical to SEQ ID NO: 66759
  Payload ID: 13308
  Gene Symbol: PAQR8
  Gene Name: progestin and adipoQ receptor family member VIII
  Uniprot ID: Q8TEZ7
  ENSP ID: ENSP00000406197

SEQ ID NO: 66761 - protein, 112 aa, Homo sapiens
  Payload ID: 13308
  Gene Symbol: PAQR8
  Gene Name: progestin and adipoQ receptor family member VIII
  ENSP ID: ENSP00000427161
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPL

SEQ ID NO: 66762 - protein, 288 aa, Homo sapiens
  Payload ID: 13309
  Gene Symbol: PDCD1
  Gene Name: programmed cell death 1
  Uniprot ID: Q15116
  ENSP ID: ENSP00000335062
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 66763 - protein, 122 aa, Homo sapiens
  Payload ID: 13309
  Gene Symbol: PDCD1
  Gene Name: programmed cell death 1
  ENSP ID: ENSP00000340808
  MOD_RES (1)..(1): Any amino acid
XNTSESFVLNWYRMSPSNQTDKLAAFPEDRSQPGQDCRFRVTQLPNGRDFHMSVVRARRNDSGTYLCGAISLAPKAQIKESLRAELRVTGTIGARRTGQPLKEDPSAVPVFSVDYGELDFQW

SEQ ID NO: 66764 - protein, 66 aa, Homo sapiens
  Payload ID: 13309
  Gene Symbol: PDCD1
  Gene Name: programmed cell death 1
  ENSP ID: ENSP00000390296
MQIPQAPWPVVWAVLQLGWRPGWFLDSPDRPWNPPTFSPALLVVTEGDNATFTCSFSNTSESFVLN

SEQ ID NO: 66765 - protein, 288 aa, Homo sapiens; identical to SEQ ID NO: 66762
  Payload ID: 13309
  Gene Symbol: PDCD1
  Gene Name: programmed cell death 1
  Uniprot ID: Q15116
  ENSP ID: ENSP00000480684

SEQ ID NO: 66766 - protein, 66 aa, Homo sapiens; identical to SEQ ID NO: 66764
  Payload ID: 13309
  Gene Symbol: PDCD1
  Gene Name: programmed cell death 1
  ENSP ID: ENSP00000486779

SEQ ID NO: 66767 - protein, 122 aa, Homo sapiens; identical to SEQ ID NO: 66763
  Payload ID: 13309
  Gene Symbol: PDCD1
  Gene Name: programmed cell death 1
  ENSP ID: ENSP00000487175
  MOD_RES (1)..(1): Any amino acid

SEQ ID NO: 66768 - protein, 273 aa, Homo sapiens
  Payload ID: 13310
  Gene Symbol: PDCD1LG2
  Gene Name: programmed cell death 1 ligand 2
  Uniprot ID: Q9BQ51
  ENSP ID: ENSP00000380855
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 66769 - protein, 212 aa, Homo sapiens
  Payload ID: 13311
  Gene Symbol: PDCD10
  Gene Name: programmed cell death 10
  Uniprot ID: Q9BUL8
  ENSP ID: ENSP00000376506
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 66770 - protein, 202 aa, Homo sapiens
  Payload ID: 13311
  Gene Symbol: PDCD10
  Gene Name: programmed cell death 10
  ENSP ID: ENSP00000417118
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTN

SEQ ID NO: 66771 - protein, 212 aa, Homo sapiens; identical to SEQ ID NO: 66769
  Payload ID: 13311
  Gene Symbol: PDCD10
  Gene Name: programmed cell death 10
  Uniprot ID: Q9BUL8
  ENSP ID: ENSP00000417202

SEQ ID NO: 66772 - protein, 149 aa, Homo sapiens
  Payload ID: 13311
  Gene Symbol: PDCD10
  Gene Name: programmed cell death 10
  ENSP ID: ENSP00000417309
MKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 66773 - protein, 186 aa, Homo sapiens
  Payload ID: 13311
  Gene Symbol: PDCD10
  Gene Name: programmed cell death 10
  ENSP ID: ENSP00000417876
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGK

SEQ ID NO: 66774 - protein, 79 aa, Homo sapiens
  Payload ID: 13311
  Gene Symbol: PDCD10
  Gene Name: programmed cell death 10
  ENSP ID: ENSP00000418160
MRMTMEEMKNEAETTSMVSMPLYAVMYPVFNELERVNLSAAQTLRAAFIKAEKENPGLTQDIIMKILEKKSVEVNFTES

SEQ ID NO: 66775 - protein, 212 aa, Homo sapiens; identical to SEQ ID NO: 66769
  Payload ID: 13311
  Gene Symbol: PDCD10
  Gene Name: programmed cell death 10
  Uniprot ID: Q9BUL8
  ENSP ID: ENSP00000418317

SEQ ID NO: 66776 - protein, 134 aa, Homo sapiens
  Payload ID: 13311
  Gene Symbol: PDCD10
  Gene Name: programmed cell death 10
  ENSP ID: ENSP00000420014
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDI

SEQ ID NO: 66777 - protein, 212 aa, Homo sapiens; identical to SEQ ID NO: 66769
  Payload ID: 13311
  Gene Symbol: PDCD10
  Gene Name: programmed cell death 10
  Uniprot ID: Q9BUL8
  ENSP ID: ENSP00000420021

SEQ ID NO: 66778 - protein, 186 aa, Homo sapiens; identical to SEQ ID NO: 66773
  Payload ID: 13311
  Gene Symbol: PDCD10
  Gene Name: programmed cell death 10
  ENSP ID: ENSP00000420266

SEQ ID NO: 66779 - protein, 122 aa, Homo sapiens
  Payload ID: 13311
  Gene Symbol: PDCD10
  Gene Name: programmed cell death 10
  ENSP ID: ENSP00000420308
  MOD_RES (1)..(1): Any amino acid
XPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKHLNTKRKNL

SEQ ID NO: 66780 - protein, 146 aa, Homo sapiens
  Payload ID: 13311
  Gene Symbol: PDCD10
  Gene Name: programmed cell death 10
  ENSP ID: ENSP00000420424
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVN

SEQ ID NO: 66781 - protein, 59 aa, Homo sapiens
  Payload ID: 13311
  Gene Symbol: PDCD10
  Gene Name: programmed cell death 10
  ENSP ID: ENSP00000420450
MRMTMEEMKNEAETTSMVSMPLYAVMYPVFNELERVNLSAAQTLRAAFIKGKKERKSSA

SEQ ID NO: 66782 - protein, 212 aa, Homo sapiens; identical to SEQ ID NO: 66769
  Payload ID: 13311
  Gene Symbol: PDCD10
  Gene Name: programmed cell death 10
  Uniprot ID: Q9BUL8
  ENSP ID: ENSP00000420553

SEQ ID NO: 66783 - protein, 1871 aa, Homo sapiens
  Payload ID: 13312
  Gene Symbol: PDCD11
  Gene Name: programmed cell death 11
  Uniprot ID: Q14690
  ENSP ID: ENSP00000358812
MANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTLLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLED

SEQ ID NO: 66784 - protein, 38 aa, Homo sapiens
  Payload ID: 13312
  Gene Symbol: PDCD11
  Gene Name: programmed cell death 11
  ENSP ID: ENSP00000474606
MANLEESFPRGGTRKIHKPEKAFQQSVEQDNLFDVCIM

SEQ ID NO: 66785 - protein, 221 aa, Homo sapiens
  Payload ID: 13313
  Gene Symbol: PDCD2
  Gene Name: programmed cell death 2
  ENSP ID: ENSP00000167218
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMDS

SEQ ID NO: 66786 - protein, 311 aa, Homo sapiens
  Payload ID: 13313
  Gene Symbol: PDCD2
  Gene Name: programmed cell death 2
  Uniprot ID: Q16342
  ENSP ID: ENSP00000375940
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 66787 - protein, 195 aa, Homo sapiens
  Payload ID: 13313
  Gene Symbol: PDCD2
  Gene Name: programmed cell death 2
  Uniprot ID: Q16342
  ENSP ID: ENSP00000397272
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGKQFQDFIH

SEQ ID NO: 66788 - protein, 228 aa, Homo sapiens
  Payload ID: 13313
  Gene Symbol: PDCD2
  Gene Name: programmed cell death 2
  Uniprot ID: Q16342
  ENSP ID: ENSP00000402524
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGKQFQDFIH

SEQ ID NO: 66789 - protein, 40 aa, Homo sapiens
  Payload ID: 13313
  Gene Symbol: PDCD2
  Gene Name: programmed cell death 2
  ENSP ID: ENSP00000439236
FLLQVYAPLPGRPDAFHRCIFLFCCREQPCCAGLRGFVAV

SEQ ID NO: 66790 - protein, 344 aa, Homo sapiens
  Payload ID: 13313
  Gene Symbol: PDCD2
  Gene Name: programmed cell death 2
  Uniprot ID: Q16342
  ENSP ID: ENSP00000439467
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 66791 - protein, 298 aa, Homo sapiens
  Payload ID: 13313
  Gene Symbol: PDCD2
  Gene Name: programmed cell death 2
  ENSP ID: ENSP00000439914
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQFSDTVY

SEQ ID NO: 66792 - protein, 46 aa, Homo sapiens
  Payload ID: 13313
  Gene Symbol: PDCD2
  Gene Name: programmed cell death 2
  ENSP ID: ENSP00000440117
  MOD_RES (1)..(1): Any amino acid
XGRPLSFLLQVYAPLPGRPDAFHRCIFLFCCREQPCCAGLRGFVAV

SEQ ID NO: 66793 - protein, 188 aa, Homo sapiens
  Payload ID: 13313
  Gene Symbol: PDCD2
  Gene Name: programmed cell death 2
  Uniprot ID: Q16342
  ENSP ID: ENSP00000440572
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 66794 - protein, 35 aa, Homo sapiens
  Payload ID: 13313
  Gene Symbol: PDCD2
  Gene Name: programmed cell death 2
  ENSP ID: ENSP00000441098
YAPLPGRPDAFHRCIFLFCCREQPCCAGLRGFVAV

SEQ ID NO: 66795 - protein, 99 aa, Homo sapiens
  Payload ID: 13313
  Gene Symbol: PDCD2
  Gene Name: programmed cell death 2
  ENSP ID: ENSP00000441977
MAAAGARPVELGFAESAPAWRLRSEQFPSKVGGRPAWLGAAGLPGPQALACELCGRPLSFLLQVYAPLPGRPDAFHRCIFLFCCREQPCCAGLRGFVAV

SEQ ID NO: 66796 - protein, 21 aa, Homo sapiens
  Payload ID: 13313
  Gene Symbol: PDCD2
  Gene Name: programmed cell death 2
  ENSP ID: ENSP00000442815
MPEVVEKEDYSEIIGSMGEAL

SEQ ID NO: 66797 - protein, 99 aa, Homo sapiens; identical to SEQ ID NO: 66795
  Payload ID: 13313
  Gene Symbol: PDCD2
  Gene Name: programmed cell death 2
  ENSP ID: ENSP00000444066

SEQ ID NO: 66798 - protein, 221 aa, Homo sapiens
  Payload ID: 13313
  Gene Symbol: PDCD2
  Gene Name: programmed cell death 2
  ENSP ID: ENSP00000481860
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 66799 - protein, 358 aa, Homo sapiens
  Payload ID: 13314
  Gene Symbol: PDCD2L
  Gene Name: programmed cell death 2-like
  Uniprot ID: Q9BRP1
  ENSP ID: ENSP00000246535
MAAVLKPVLLGLRDAPVHGSPTGPGAWTASKLGGIPDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 66800 - protein, 56 aa, Homo sapiens
  Payload ID: 13314
  Gene Symbol: PDCD2L
  Gene Name: programmed cell death 2-like
  ENSP ID: ENSP00000475984
MPALVSMLKSANLGLSVEFGTILVYTCEKSCWPPNHQTPMEEFCIIQEDPDELLFK

SEQ ID NO: 66801 - protein, 469 aa, Homo sapiens
  Payload ID: 13315
  Gene Symbol: PDCD4
  Gene Name: programmed cell death 4 (neoplastic transformation inhibitor)
  Uniprot ID: Q53EL6
  ENSP ID: ENSP00000280154
MDVENEQILNVNPADPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 66802 - protein, 458 aa, Homo sapiens
  Payload ID: 13315
  Gene Symbol: PDCD4
  Gene Name: programmed cell death 4 (neoplastic transformation inhibitor)
  Uniprot ID: Q53EL6
  ENSP ID: ENSP00000376816
MTKYPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 66803 - protein, 231 aa, Homo sapiens
  Payload ID: 13315
  Gene Symbol: PDCD4
  Gene Name: programmed cell death 4 (neoplastic transformation inhibitor)
  ENSP ID: ENSP00000394668
MDVENEQILNVNPAENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLK

SEQ ID NO: 66804 - protein, 55 aa, Homo sapiens
  Payload ID: 13316
  Gene Symbol: PDCD5
  Gene Name: programmed cell death 5
  ENSP ID: ENSP00000221784
MADEELEALRRQRLAELQAKHGDPGDAAQQEAKHSRNEKQYLSPSSGSVGPGQVK

SEQ ID NO: 66805 - protein, 40 aa, Homo sapiens
  Payload ID: 13316
  Gene Symbol: PDCD5
  Gene Name: programmed cell death 5
  ENSP ID: ENSP00000368620
MADEELEALRRQRLAELQAKHGDPGDAAQQEAKHSSTEEK

SEQ ID NO: 66806 - protein, 125 aa, Homo sapiens
  Payload ID: 13316
  Gene Symbol: PDCD5
  Gene Name: programmed cell death 5
  Uniprot ID: O14737
  ENSP ID: ENSP00000466214
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 66807 - protein, 87 aa, Homo sapiens
  Payload ID: 13316
  Gene Symbol: PDCD5
  Gene Name: programmed cell death 5
  ENSP ID: ENSP00000467737
MRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 66808 - protein, 65 aa, Homo sapiens
  Payload ID: 13316
  Gene Symbol: PDCD5
  Gene Name: programmed cell death 5
  ENSP ID: ENSP00000468741
MADEELEALRRQRLAELQAKHGDPGDAAQQEAKHREAEMRNSILAQVLDQSARARCIRTRFNRNP

SEQ ID NO: 66809 - protein, 129 aa, Homo sapiens
  Payload ID: 13316
  Gene Symbol: PDCD5
  Gene Name: programmed cell death 5
  Uniprot ID: O14737
  ENSP ID: ENSP00000476525
MADEELEALRRQRLAELQAKHGDPGDAAQQEAKHREAEMRNSILAQVLDQSARARLSNLALVKPEKTKAVENYLIQMARYGQLSEKVSLDSLEELYCYLLYQNMASKGQLHLHWITEFLLTLRRNCWRE

SEQ ID NO: 66810 - protein, 191 aa, Homo sapiens
  Payload ID: 13317
  Gene Symbol: PDCD6
  Gene Name: programmed cell death 6
  Uniprot ID: O75340
  ENSP ID: ENSP00000264933
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 66811 - protein, 69 aa, Homo sapiens
  Payload ID: 13317
  Gene Symbol: PDCD6
  Gene Name: programmed cell death 6
  Uniprot ID: O75340
  ENSP ID: ENSP00000422085
MAAYSYRPGPGAGPGPAAGAALPDQSFLWNVFQRVDKDRSGVISDTELQQALSNGTWTPFNPVTVRSII

SEQ ID NO: 66812 - protein, 55 aa, Homo sapiens
  Payload ID: 13317
  Gene Symbol: PDCD6
  Gene Name: programmed cell death 6
  ENSP ID: ENSP00000422691
MAAYSYRPGPGAGPGPAAGAALPDQSFLWNVFQRVDKDRSGVISDTELQQALSNG

SEQ ID NO: 66813 - protein, 189 aa, Homo sapiens
  Payload ID: 13317
  Gene Symbol: PDCD6
  Gene Name: programmed cell death 6
  Uniprot ID: O75340
  ENSP ID: ENSP00000423815
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGYRLSDQFHDILIRKFDRQGRGQIAFDDFIQGCIVLQRLTDIFRRYDTDQDGWIQVSYEQYLSMVFSIV

SEQ ID NO: 66814 - protein, 39 aa, Homo sapiens
  Payload ID: 13317
  Gene Symbol: PDCD6
  Gene Name: programmed cell death 6
  ENSP ID: ENSP00000424201
MAAYSYRPGPGAGPGPAAGAALPDQSFLWNVFQRHVDSL

SEQ ID NO: 66815 - protein, 104 aa, Homo sapiens
  Payload ID: 13317
  Gene Symbol: PDCD6
  Gene Name: programmed cell death 6
  ENSP ID: ENSP00000425370
VDKDRSGVISDTELQQALSNGTWTPFNPVTVRSIICYRLSDQFHDILIRKFDRQGRGQIAFDDFIQGCIVLQRLTDIFRRYDTDQDGWIQVSYEQYLSMVFSIV

SEQ ID NO: 66816 - protein, 73 aa, Homo sapiens
  Payload ID: 13317
  Gene Symbol: PDCD6
  Gene Name: programmed cell death 6
  ENSP ID: ENSP00000426003
MAAYSYRPGPGAGPGPAAGAALPDQSFLWNVFQRVDKDRSGVISDTELQQALSNGTWTPFNPVTVRSIICRGR

SEQ ID NO: 66817 - protein, 123 aa, Homo sapiens
  Payload ID: 13317
  Gene Symbol: PDCD6
  Gene Name: programmed cell death 6
  ENSP ID: ENSP00000482332
MAAYSYRPGPGAGPGPAAGAALPDQSFLWNVFQRVDKDRSGVISDTELQQALSNGYRLSDQFHDILIRKFDRQGRGQIAFDDFIQGCIVLQRLTDIFRRYDTDQDGWIQVSYEQYLSMVFSIV

SEQ ID NO: 66818 - protein, 121 aa, Homo sapiens
  Payload ID: 13317
  Gene Symbol: PDCD6
  Gene Name: programmed cell death 6
  ENSP ID: ENSP00000485024
MFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 66819 - protein, 39 aa, Homo sapiens; identical to SEQ ID NO: 66814
  Payload ID: 13317
  Gene Symbol: PDCD6
  Gene Name: programmed cell death 6
  ENSP ID: ENSP00000485941

SEQ ID NO: 66820 - protein, 868 aa, Homo sapiens
  Payload ID: 13318
  Gene Symbol: PDCD6IP
  Gene Name: programmed cell death 6 interacting protein
  Uniprot ID: Q8WUM4
  ENSP ID: ENSP00000307387
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 66821 - protein, 72 aa, Homo sapiens
  Payload ID: 13318
  Gene Symbol: PDCD6IP
  Gene Name: programmed cell death 6 interacting protein
  ENSP ID: ENSP00000393777
MATFISVQLKKTSEVDLAKPLVKFIQQTYPSGGEEQAQYCRAAEELSKLRRAAVGRPLDKHEGALETLLRSA

SEQ ID NO: 66822 - protein, 78 aa, Homo sapiens
  Payload ID: 13318
  Gene Symbol: PDCD6IP
  Gene Name: programmed cell death 6 interacting protein
  ENSP ID: ENSP00000398895
MATFISVQLKKTSEVDLAKPLVKFIQQTYPSGGEEQAQYCRAAEELSKLRRAAVGRPLDKHEGALETLLRLVSNSGLK

SEQ ID NO: 66823 - protein, 153 aa, Homo sapiens
  Payload ID: 13318
  Gene Symbol: PDCD6IP
  Gene Name: programmed cell death 6 interacting protein
  ENSP ID: ENSP00000406693
MATFISVQLKKTSEVDLAKPLVKFIQQTYPSGGEEQAQYCRAAEELSKLRRAAVGRPLDKHEGALETLLRYYDQICSIEPKFPFSENQNLDNDEGLKIAAKHYQFASGAFLHIKETVLSALSREPTVDISPDTVGTLSLIMLAQAQEVFFLKA

SEQ ID NO: 66824 - protein, 873 aa, Homo sapiens
  Payload ID: 13318
  Gene Symbol: PDCD6IP
  Gene Name: programmed cell death 6 interacting protein
  Uniprot ID: Q8WUM4
  ENSP ID: ENSP00000411825
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKYFYFQEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 66825 - protein, 95 aa, Homo sapiens
  Payload ID: 13318
  Gene Symbol: PDCD6IP
  Gene Name: programmed cell death 6 interacting protein
  ENSP ID: ENSP00000415150
MLAQAQEVFFLKATRDKMKDAIIAKLANQAADYFGDAFKQCQYKDTLPKEVFPVLAAKHCIMQANAEYHQSILAKQQKKFGEEIARLQIHPFTES

SEQ ID NO: 66826 - protein, 485 aa, Homo sapiens
  Payload ID: 13319
  Gene Symbol: PDCD7
  Gene Name: programmed cell death 7
  Uniprot ID: Q8N8D1
  ENSP ID: ENSP00000204549
MALPPFFGQGRPGPPPPQPPPPAPFGCPPPPLPSPAFPPPLPQRPGPFPGASAPFLQPPLALQPRASAEASRGGGGAGAFYPVPPPPLPPPPPQCRPFPGTDAGERPRPPPPGPGPPWSPRWPEAPPPPADVLGDAALQRLRDRQWLEAVFGTPRRAGCPVPQRTHAGPSLGEVRARLLRALRLVRRLRGLSQALREAEADGAAWVLLYSQTAPLRAELAERLQPLTQAAYVGEARRRLERVRRRRLRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 66827 - protein, 103 aa, Homo sapiens
  Payload ID: 13319
  Gene Symbol: PDCD7
  Gene Name: programmed cell death 7
  ENSP ID: ENSP00000457053
EQELKAAADGVLSEVRKKQADTKRMVDILRALEKLRKLRKEAAARKDEFPLAHLLEPFRQYYLQAEHSLPALIQIRHDWDQYLVPSDHPKGNFVPQGWVLPPL

SEQ ID NO: 66828 - protein, 54 aa, Homo sapiens
  Payload ID: 13320
  Gene Symbol: PRCD
  Gene Name: progressive rod-cone degeneration
  Uniprot ID: Q00LT1
  ENSP ID: ENSP00000465932
MCTTLFLLSTLAMLWRRRFANRVQPEPSDVDGAARGSSLDADPQSSGREKEPLK

SEQ ID NO: 66829 - protein, 54 aa, Homo sapiens; identical to SEQ ID NO: 66828
  Payload ID: 13320
  Gene Symbol: PRCD
  Gene Name: progressive rod-cone degeneration
  Uniprot ID: Q00LT1
  ENSP ID: ENSP00000467661

SEQ ID NO: 66830 - protein, 272 aa, Homo sapiens
  Payload ID: 13321
  Gene Symbol: PHB
  Gene Name: prohibitin
  Uniprot ID: P35232
  ENSP ID: ENSP00000300408
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 66831 - protein, 246 aa, Homo sapiens
  Payload ID: 13321
  Gene Symbol: PHB
  Gene Name: prohibitin
  ENSP ID: ENSP00000393320
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAED

SEQ ID NO: 66832 - protein, 201 aa, Homo sapiens
  Payload ID: 13321
  Gene Symbol: PHB
  Gene Name: prohibitin
  ENSP ID: ENSP00000407828
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVE

SEQ ID NO: 66833 - protein, 124 aa, Homo sapiens
  Payload ID: 13321
  Gene Symbol: PHB
  Gene Name: prohibitin
  ENSP ID: ENSP00000410680
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITT

SEQ ID NO: 66834 - protein, 202 aa, Homo sapiens
  Payload ID: 13321
  Gene Symbol: PHB
  Gene Name: prohibitin
  ENSP ID: ENSP00000422182
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEK

SEQ ID NO: 66835 - protein, 155 aa, Homo sapiens
  Payload ID: 13321
  Gene Symbol: PHB
  Gene Name: prohibitin
  Uniprot ID: P35232
  ENSP ID: ENSP00000425035
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITYLPAGQSVLLQLPQ

SEQ ID NO: 66836 - protein, 216 aa, Homo sapiens
  Payload ID: 13321
  Gene Symbol: PHB
  Gene Name: prohibitin
  ENSP ID: ENSP00000426433
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEG

SEQ ID NO: 66837 - protein, 272 aa, Homo sapiens; identical to SEQ ID NO: 66830
  Payload ID: 13321
  Gene Symbol: PHB
  Gene Name: prohibitin
  Uniprot ID: P35232
  ENSP ID: ENSP00000479488

SEQ ID NO: 66838 - protein, 272 aa, Homo sapiens; identical to SEQ ID NO: 66830
  Payload ID: 13321
  Gene Symbol: PHB
  Gene Name: prohibitin
  Uniprot ID: P35232
  ENSP ID: ENSP00000484113

SEQ ID NO: 66839 - protein, 298 aa, Homo sapiens
  Payload ID: 13322
  Gene Symbol: PHB2
  Gene Name: prohibitin 2
  ENSP ID: ENSP00000382362
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTIATSQNRIYLTADNLVLNLQDESFTRSDSLIKGKK

SEQ ID NO: 66840 - protein, 261 aa, Homo sapiens
  Payload ID: 13322
  Gene Symbol: PHB2
  Gene Name: prohibitin 2
  Uniprot ID: Q99623
  ENSP ID: ENSP00000412856
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVALSKNPGYIKLRKIRAAQNISKTIATSQNRIYLTADNLVLNLQDESFTRGSDSLIKGKK

SEQ ID NO: 66841 - protein, 112 aa, Homo sapiens
  Payload ID: 13322
  Gene Symbol: PHB2
  Gene Name: prohibitin 2
  ENSP ID: ENSP00000438068
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTDGEYLPASVVSTQCSGAS

SEQ ID NO: 66842 - protein, 87 aa, Homo sapiens
  Payload ID: 13322
  Gene Symbol: PHB2
  Gene Name: prohibitin 2
  ENSP ID: ENSP00000438634
MAQNLKDLAGRLPAGPRGMGTALKLLLGAGAVAYGVRESVFTVEGGHRAIFFNRIGGVQQDTILAEGLHFRSPHHRIVSISQLTTLC

SEQ ID NO: 66843 - protein, 213 aa, Homo sapiens
  Payload ID: 13322
  Gene Symbol: PHB2
  Gene Name: prohibitin 2
  ENSP ID: ENSP00000439029
MAQNLKDLAGRLPAGPRGMGTALKLLLGAGAVAYGVRESVFTVEGGHRAIFFNRIGGVQQDTILAEGLHFRVVPGCTPLHRAYREEHEGENAWERVFGLDQPLLTSISDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQV

SEQ ID NO: 66844 - protein, 267 aa, Homo sapiens
  Payload ID: 13322
  Gene Symbol: PHB2
  Gene Name: prohibitin 2
  ENSP ID: ENSP00000440317
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTPHQG

SEQ ID NO: 66845 - protein, 261 aa, Homo sapiens
  Payload ID: 13322
  Gene Symbol: PHB2
  Gene Name: prohibitin 2
  ENSP ID: ENSP00000441662
MAQNLKDLAGRLPAGPRGMGTALKLLLGAGAVAYGVRESVFTVEGGHRAIFFNRIGGVQQDTILAEGLHFSGCCENLQQHTNCCFPEGQENLSLSVVVERSRPKNAWIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKI

SEQ ID NO: 66846 - protein, 299 aa, Homo sapiens
  Payload ID: 13322
  Gene Symbol: PHB2
  Gene Name: prohibitin 2
  Uniprot ID: Q99623
  ENSP ID: ENSP00000441875
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTIATSQNRIYLTADNLVLNLQDESFTRGSDSLIKGKK

SEQ ID NO: 66847 - protein, 103 aa, Homo sapiens
  Payload ID: 13322
  Gene Symbol: PHB2
  Gene Name: prohibitin 2
  ENSP ID: ENSP00000475382
  MOD_RES (1)..(1): Any amino acid
XDDVAITELSFSREYTAAVEAKQPRGGLEQGSVVRTGPGIETCPCVYLNPPHLGEALSKNPGYIKLRKIRAAQNISKTIATSQNRIYLTADNLVLNLQDESFT

SEQ ID NO: 66848 - protein, 105 aa, Homo sapiens
  Payload ID: 13323
  Gene Symbol: PROK1
  Gene Name: prokineticin 1
  Uniprot ID: P58294
  ENSP ID: ENSP00000271331
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 66849 - protein, 108 aa, Homo sapiens
  Payload ID: 13324
  Gene Symbol: PROK2
  Gene Name: prokineticin 2
  Uniprot ID: Q9HC23
  ENSP ID: ENSP00000295618
MRSLCCAPLLLLLLLPPLLLTPRAGDAAVITGACDKDSQCGGGMCCAVSIWVKSIRICTPMGKLGDSCHPLTRKVPFFGRRMHHTCPCLPGLACLRTSFNRFICLAQK

SEQ ID NO: 66850 - protein, 129 aa, Homo sapiens
  Payload ID: 13324
  Gene Symbol: PROK2
  Gene Name: prokineticin 2
  Uniprot ID: Q9HC23
  ENSP ID: ENSP00000295619
MRSLCCAPLLLLLLLPPLLLTPRAGDAAVITGACDKDSQCGGGMCCAVSIWVKSIRICTPMGKLGDSCHPLTRKNNFGNGRQERRKRKRSKRKKEVPFFGRRMHHTCPCLPGLACLRTSFNRFICLAQK

SEQ ID NO: 66851 - protein, 393 aa, Homo sapiens; identical to SEQ ID NO: 5932
  Payload ID: 13325
  Gene Symbol: PROKR1
  Gene Name: prokineticin receptor 1
  Uniprot ID: Q8TCW9
  ENSP ID: ENSP00000303775

SEQ ID NO: 66852 - protein, 384 aa, Homo sapiens
  Payload ID: 13326
  Gene Symbol: PROKR2
  Gene Name: prokineticin receptor 2
  Uniprot ID: Q8NFJ6
  ENSP ID: ENSP00000217270
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 66853 - protein, 227 aa, Homo sapiens
  Payload ID: 13327
  Gene Symbol: PRL
  Gene Name: prolactin
  Uniprot ID: P01236
  ENSP ID: ENSP00000302150
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 66854 - protein, 196 aa, Homo sapiens
  Payload ID: 13327
  Gene Symbol: PRL
  Gene Name: prolactin
  ENSP ID: ENSP00000478566
MNIKGSPWKGSLLLLLVSNLLLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 66855 - protein, 228 aa, Homo sapiens
  Payload ID: 13327
  Gene Symbol: PRL
  Gene Name: prolactin
  ENSP ID: ENSP00000480195
MNIKGSPWKAGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 66856 - protein, 376 aa, Homo sapiens
  Payload ID: 13328
  Gene Symbol: PRLR
  Gene Name: prolactin receptor
  Uniprot ID: P16471
  ENSP ID: ENSP00000231423
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGDPLMLGASHYKNLKSYRPRKISSQGRLAVFTKATLTTVQ

SEQ ID NO: 66857 - protein, 349 aa, Homo sapiens
  Payload ID: 13328
  Gene Symbol: PRLR
  Gene Name: prolactin receptor
  Uniprot ID: P16471
  ENSP ID: ENSP00000309008
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQEREQRQAQEARDS

SEQ ID NO: 66858 - protein, 268 aa, Homo sapiens
  Payload ID: 13328
  Gene Symbol: PRLR
  Gene Name: prolactin receptor
  Uniprot ID: P16471
  ENSP ID: ENSP00000311613
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSGDPLMLGASHYKNLKSYRPRKISSQGRLAVFTKATLTTVQ

SEQ ID NO: 66859 - protein, 34 aa, Homo sapiens
  Payload ID: 13328
  Gene Symbol: PRLR
  Gene Name: prolactin receptor
  ENSP ID: ENSP00000380546
MKENVASATVFTLLLFLNTCLLNERHSCMNVQTT

SEQ ID NO: 66860 - protein, 34 aa, Homo sapiens
  Payload ID: 13328
  Gene Symbol: PRLR
  Gene Name: prolactin receptor
  ENSP ID: ENSP00000421864
MKENVASATVFTLLLFLNTCLLNGQLPPGKPEIF

SEQ ID NO: 66861 - protein, 102 aa, Homo sapiens
  Payload ID: 13328
  Gene Symbol: PRLR
  Gene Name: prolactin receptor
  ENSP ID: ENSP00000422385
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMM

SEQ ID NO: 66862 - protein, 521 aa, Homo sapiens
  Payload ID: 13328
  Gene Symbol: PRLR
  Gene Name: prolactin receptor
  Uniprot ID: P16471
  ENSP ID: ENSP00000422556
MKENVASATVFTLLLFLNTCLLNVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 66863 - protein, 62 aa, Homo sapiens
  Payload ID: 13328
  Gene Symbol: PRLR
  Gene Name: prolactin receptor
  ENSP ID: ENSP00000422867
MKENVASATVFTLLLFLNTCLLNGQLPPGKPEIFKCRSPNKETFTCWWRPGTDGGLPTNYSL

SEQ ID NO: 66864 - protein, 268 aa, Homo sapiens; identical to SEQ ID NO: 66858
  Payload ID: 13328
  Gene Symbol: PRLR
  Gene Name: prolactin receptor
  Uniprot ID: P16471
  ENSP ID: ENSP00000422935

SEQ ID NO: 66865 - protein, 120 aa, Homo sapiens
  Payload ID: 13328
  Gene Symbol: PRLR
  Gene Name: prolactin receptor
  ENSP ID: ENSP00000423493
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVD

SEQ ID NO: 66866 - protein, 288 aa, Homo sapiens
  Payload ID: 13328
  Gene Symbol: PRLR
  Gene Name: prolactin receptor
  Uniprot ID: P16471
  ENSP ID: ENSP00000424841
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEVTP

SEQ ID NO: 66867 - protein, 288 aa, Homo sapiens; identical to SEQ ID NO: 66866
  Payload ID: 13328
  Gene Symbol: PRLR
  Gene Name: prolactin receptor
  Uniprot ID: P16471
  ENSP ID: ENSP00000425300

SEQ ID NO: 66868 - protein, 111 aa, Homo sapiens
  Payload ID: 13328
  Gene Symbol: PRLR
  Gene Name: prolactin receptor
  ENSP ID: ENSP00000427060
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGS

SEQ ID NO: 66869 - protein, 33 aa, Homo sapiens
  Payload ID: 13328
  Gene Symbol: PRLR
  Gene Name: prolactin receptor
  ENSP ID: ENSP00000427236
MKENVASATVFTLLLFLNTCLLNDPFCWAANRV

SEQ ID NO: 66870 - protein, 376 aa, Homo sapiens; identical to SEQ ID NO: 66856
  Payload ID: 13328
  Gene Symbol: PRLR
  Gene Name: prolactin receptor
  Uniprot ID: P16471
  ENSP ID: ENSP00000441813

SEQ ID NO: 66871 - protein, 34 aa, Homo sapiens; identical to SEQ ID NO: 66859
  Payload ID: 13328
  Gene Symbol: PRLR
  Gene Name: prolactin receptor
  ENSP ID: ENSP00000479077

SEQ ID NO: 66872 - protein, 521 aa, Homo sapiens; identical to SEQ ID NO: 66862
  Payload ID: 13328
  Gene Symbol: PRLR
  Gene Name: prolactin receptor
  Uniprot ID: P16471
  ENSP ID: ENSP00000482689

SEQ ID NO: 66873 - protein, 622 aa, Homo sapiens
  Payload ID: 13328
  Gene Symbol: PRLR
  Gene Name: prolactin receptor
  Uniprot ID: P16471
  ENSP ID: ENSP00000482954
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 66874 - protein, 349 aa, Homo sapiens; identical to SEQ ID NO: 66857
  Payload ID: 13328
  Gene Symbol: PRLR
  Gene Name: prolactin receptor
  Uniprot ID: P16471
  ENSP ID: ENSP00000484768

SEQ ID NO: 66875 - protein, 417 aa, Homo sapiens
  Payload ID: 13329
  Gene Symbol: PREB
  Gene Name: prolactin regulatory element binding
  Uniprot ID: Q9HCU5
  ENSP ID: ENSP00000260643
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACRFGQVPDQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 66876 - protein, 359 aa, Homo sapiens
  Payload ID: 13329
  Gene Symbol: PREB
  Gene Name: prolactin regulatory element binding
  ENSP ID: ENSP00000384032
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 66877 - protein, 22 aa, Homo sapiens
  Payload ID: 13329
  Gene Symbol: PREB
  Gene Name: prolactin regulatory element binding
  ENSP ID: ENSP00000391894
VVSCLDVRCETLLPWLVNPAPS

SEQ ID NO: 66878 - protein, 176 aa, Homo sapiens
  Payload ID: 13329
  Gene Symbol: PREB
  Gene Name: prolactin regulatory element binding
  ENSP ID: ENSP00000397036
  MOD_RES (1)..(1): Any amino acid
XQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRECSCVAPAPAVCRAYYCDHPAAPECLSRFPLASLLPGNQEPGHCHL

SEQ ID NO: 66879 - protein, 106 aa, Homo sapiens
  Payload ID: 13329
  Gene Symbol: PREB
  Gene Name: prolactin regulatory element binding
  ENSP ID: ENSP00000407036
  MOD_RES (1)..(1): Any amino acid
XRYQACRFGQVPDQPAGLRLFTVQIPHKRLRQPPPCYLTAWDGSNFLPLRTKSCGHEVVSCLDVSESGTFLGLGTVTGSVAIYIAFSLQGVFLCGSCSCCVSGLLL

SEQ ID NO: 66880 - protein, 50 aa, Homo sapiens
  Payload ID: 13329
  Gene Symbol: PREB
  Gene Name: prolactin regulatory element binding
  ENSP ID: ENSP00000416103
MGRRRAPELYRAPFPLYALQVDPSTGLLIAAGGGGAAKTGIKNGVRHGPP

SEQ ID NO: 66881 - protein, 87 aa, Homo sapiens
  Payload ID: 13330
  Gene Symbol: PRLH
  Gene Name: prolactin releasing hormone
  Uniprot ID: P81277
  ENSP ID: ENSP00000165524
MKVLRAWLLCLLMLGLALRGAASRTHRHSMEIRTPDINPAWYASRGIRPVGRFGRRRATLGDVPKPGLRPRLTCFPLEGGAMSSQDG

SEQ ID NO: 66882 - protein, 370 aa, Homo sapiens
  Payload ID: 13331
  Gene Symbol: PRLHR
  Gene Name: prolactin releasing hormone receptor
  Uniprot ID: P49683
  ENSP ID: ENSP00000239032
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVIVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 66883 - protein, 146 aa, Homo sapiens
  Payload ID: 13332
  Gene Symbol: PIP
  Gene Name: prolactin-induced protein
  Uniprot ID: P12273
  ENSP ID: ENSP00000291009
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 66884 - protein, 261 aa, Homo sapiens
  Payload ID: 13333
  Gene Symbol: PCNA
  Gene Name: proliferating cell nuclear antigen
  Uniprot ID: P12004
  ENSP ID: ENSP00000368438
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 66885 - protein, 261 aa, Homo sapiens; identical to SEQ ID NO: 66884
  Payload ID: 13333
  Gene Symbol: PCNA
  Gene Name: proliferating cell nuclear antigen
  Uniprot ID: P12004
  ENSP ID: ENSP00000368458

SEQ ID NO: 66886 - protein, 394 aa, Homo sapiens
  Payload ID: 13334
  Gene Symbol: PA2G4
  Gene Name: proliferation-associated 2G4, 38kDa
  Uniprot ID: Q9UQ80
  ENSP ID: ENSP00000302886
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 66887 - protein, 64 aa, Homo sapiens
  Payload ID: 13334
  Gene Symbol: PA2G4
  Gene Name: proliferation-associated 2G4, 38kDa
  ENSP ID: ENSP00000447389
MIMEETGKIFKKEKEMKKGIAFPTSISVNNCVCHFSPLKSDQDYILKEGDLVKIDLGVHVDGFI

SEQ ID NO: 66888 - protein, 187 aa, Homo sapiens
  Payload ID: 13334
  Gene Symbol: PA2G4
  Gene Name: proliferation-associated 2G4, 38kDa
  ENSP ID: ENSP00000447615
MSAERGPWQAPTRGRLLGGVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGE

SEQ ID NO: 66889 - protein, 284 aa, Homo sapiens
  Payload ID: 13334
  Gene Symbol: PA2G4
  Gene Name: proliferation-associated 2G4, 38kDa
  ENSP ID: ENSP00000448557
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMFLNTLKMT

SEQ ID NO: 66890 - protein, 944 aa, Homo sapiens
  Payload ID: 13335
  Gene Symbol: PROSER1
  Gene Name: proline and serine rich 1
  Uniprot ID: Q86XN7
  ENSP ID: ENSP00000332034
MDKKSFEMVLDEIRKAVLTEYKLKAIEYVHGYFSSEQVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 66891 - protein, 101 aa, Homo sapiens
  Payload ID: 13335
  Gene Symbol: PROSER1
  Gene Name: proline and serine rich 1
  ENSP ID: ENSP00000413879
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQ

SEQ ID NO: 66892 - protein, 922 aa, Homo sapiens
  Payload ID: 13335
  Gene Symbol: PROSER1
  Gene Name: proline and serine rich 1
  Uniprot ID: Q86XN7
  ENSP ID: ENSP00000486159
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 66893 - protein, 435 aa, Homo sapiens
  Payload ID: 13336
  Gene Symbol: PROSER2
  Gene Name: proline and serine rich 2
  Uniprot ID: Q86WR7
  ENSP ID: ENSP00000277570
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPTPLVMAQKISERMAGNEALSPTSPFREGRPGEWRTPAARGPRSGDPGPGPSHPAQPKAPRFPSNIIVTNGAAREPRRTLSRAAVSVQERRAQVLATIHGHAGAFPAAGDAGEGAPGGGSSPERVARGRGLPGPAESLRAGGQAPRGPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 66894 - protein, 239 aa, Homo sapiens
  Payload ID: 13336
  Gene Symbol: PROSER2
  Gene Name: proline and serine rich 2
  ENSP ID: ENSP00000368498
MAQKISERMAGNEALSPTSPFREGRPGEWRTPAARGPRSGDPGPGPSHPAQPKAPRFPSNIIVTNGAAREPRRTLSRAAVSVQERRAQVLATIHGHAGAFPAAGDAGEGAPGGGSSPERVARGRGLPGPAESLRAGGQAPRGPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 66895 - protein, 85 aa, Homo sapiens
  Payload ID: 13336
  Gene Symbol: PROSER2
  Gene Name: proline and serine rich 2
  ENSP ID: ENSP00000407621
MPVTHRKSDASDMNSDTSPSCRLRAFSRGGSLESRSSSSRSRSFTLDDESLKYLTHEEKDVLLFFEETIDSLDEDFEEPVLCDGG

SEQ ID NO: 66896 - protein, 341 aa, Homo sapiens
  Payload ID: 13336
  Gene Symbol: PROSER2
  Gene Name: proline and serine rich 2
  Uniprot ID: Q86WR7
  ENSP ID: ENSP00000484913
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPTPLVMAQKISERMAGNEALSPTSPFREGRPGEWRTPAARGPRSGDPGPGPSHPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 66897 - protein, 255 aa, Homo sapiens
  Payload ID: 13337
  Gene Symbol: PROSER3
  Gene Name: proline and serine rich 3
  ENSP ID: ENSP00000301165
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAGANKPEGRPHTAVPTAVNVTSASHAVAPLQEIKQNLHTWNSSLLDLETLSLQSRAARLLKRSKASISSSSSLSPSDASTSSFPTSSDGLSPFSETFIPDSSKGLGPRAP

SEQ ID NO: 66898 - protein, 480 aa, Homo sapiens
  Payload ID: 13337
  Gene Symbol: PROSER3
  Gene Name: proline and serine rich 3
  Uniprot ID: Q2NL68
  ENSP ID: ENSP00000380116
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQNLHTWNSSLLDLETLSLQSRAARLLKRSKASISSSSSLSPSDASTSSFPTSSDGLSPFSETFIPDSSKGLGPRAPASPAPAQAQTPTPAPAPASSQAPLRPEDDILYQWRQRRKLEQAQGSKGDRAWVPPLTPALRTLAESLKAKALPPAAGSVIRKSEATPSPGACLQPEVPLSPAEQATTVKASPPAFQVGSPEALAPPPPAADHAPSEALLAQAALLLQAAEDSDGSEFQDDPVLQVLRAHRAELSRQKREADARLSFLLDQAEDLGSWSPPAGSPPRSPRRLLRREGDSLEARRL

SEQ ID NO: 66899 - protein, 86 aa, Homo sapiens
  Payload ID: 13337
  Gene Symbol: PROSER3
  Gene Name: proline and serine rich 3
  ENSP ID: ENSP00000394231
MWASPAPTLIDSGDSVVAKYINRFRQAQPTSREERQPAGPTPADFWWLQSDSPDPSSQSAAGANKPEGRPHTAVPTAVNVTSASHA

SEQ ID NO: 66900 - protein, 52 aa, Homo sapiens
  Payload ID: 13337
  Gene Symbol: PROSER3
  Gene Name: proline and serine rich 3
  ENSP ID: ENSP00000438803
  MOD_RES (1)..(1): Any amino acid
XIQDSPFGDAPLGRSHYWPSQSQTWCPKVYKQVPPGSAHQSRGAPACRPNPS

SEQ ID NO: 66901 - protein, 194 aa, Homo sapiens
  Payload ID: 13337
  Gene Symbol: PROSER3
  Gene Name: proline and serine rich 3
  Uniprot ID: Q2NL68
  ENSP ID: ENSP00000439886
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQVTSPFTPSLGCLN

SEQ ID NO: 66902 - protein, 93 aa, Homo sapiens
  Payload ID: 13337
  Gene Symbol: PROSER3
  Gene Name: proline and serine rich 3
  ENSP ID: ENSP00000440357
MWASPAPTLIDSGDSVVAKYINRFRQAQPTSREERQPAGPTPADFWWLQSDSPDPSSQSAAGANKPEGRPHTAVPTAVNVTSASHAVAPLQEI

SEQ ID NO: 66903 - protein, 193 aa, Homo sapiens
  Payload ID: 13337
  Gene Symbol: PROSER3
  Gene Name: proline and serine rich 3
  Uniprot ID: Q2NL68
  ENSP ID: ENSP00000466822
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAGANKPEGRPHTAVPTAVNVTSASHAVAPLQEIKQVTSPFTPSLGCLN

SEQ ID NO: 66904 - protein, 94 aa, Homo sapiens
  Payload ID: 13337
  Gene Symbol: PROSER3
  Gene Name: proline and serine rich 3
  ENSP ID: ENSP00000469661
MDRRYINRFRQAQPTSREERQPAGPTPADFWWLQSDSPDPSSQSAAAGANKPEGRPHTAVPTAVNVTSASHAVAPLQEIKQVTSPFTPSLGCLN

SEQ ID NO: 66905 - protein, 167 aa, Homo sapiens
  Payload ID: 13337
  Gene Symbol: PROSER3
  Gene Name: proline and serine rich 3
  ENSP ID: ENSP00000470309
  MOD_RES (1)..(1): Any amino acid
XQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQVTSPFTPSLGCLN

SEQ ID NO: 66906 - protein, 90 aa, Homo sapiens
  Payload ID: 13337
  Gene Symbol: PROSER3
  Gene Name: proline and serine rich 3
  ENSP ID: ENSP00000474471
WPSSSGTPSLPSTTEGQMWASPAPTLIDSGDSVVAKYINRFRQAQPTSREERQPAGPTPADFWWLQSDSPDPSSQSAAGTSFSAIHYSHP

SEQ ID NO: 66907 - protein, 324 aa, Homo sapiens
  Payload ID: 13337
  Gene Symbol: PROSER3
  Gene Name: proline and serine rich 3
  ENSP ID: ENSP00000482508
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAGANKPEGRPHTAVPTAVNVTSASHAVAPLQEIKQNLHTWNSSLLDLETLSLQSRAARLLKRSPSDASTSSFPTSSDGLSPFSETFIPDSSKGLGPRAPASPAPAQAQTPTPAPAPASSQAPLRPEDDILYQWRQRRKLEQAQGSKGDRAWVPPLTPALRTLVSRGREEPGGSWRRGWV

SEQ ID NO: 66908 - protein, 492 aa, Homo sapiens
  Payload ID: 13338
  Gene Symbol: PRODH
  Gene Name: proline dehydrogenase (oxidase) 1
  ENSP ID: ENSP00000334726
MKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 66909 - protein, 600 aa, Homo sapiens
  Payload ID: 13338
  Gene Symbol: PRODH
  Gene Name: proline dehydrogenase (oxidase) 1
  Uniprot ID: O43272
  ENSP ID: ENSP00000349577
MALRRALPALRPCIPRFVPLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 66910 - protein, 135 aa, Homo sapiens
  Payload ID: 13338
  Gene Symbol: PRODH
  Gene Name: proline dehydrogenase (oxidase) 1
  ENSP ID: ENSP00000396806
MESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASR

SEQ ID NO: 66911 - protein, 185 aa, Homo sapiens
  Payload ID: 13338
  Gene Symbol: PRODH
  Gene Name: proline dehydrogenase (oxidase) 1
  ENSP ID: ENSP00000409742
  MOD_RES (1)..(1): Any amino acid
XGARRGLRQRAGGVPQPANLGAGAEPAGAALVRLARAAGAPRAGPAPQLRRGMAVARISGTSNTRPTGPSGTAGMVSSVPAPTSTPMRPSATATWRHSCAASKPQLQFSEVLAKWRCFFHQMAVEQGQAGLAAMDTKLEVAVLQESVAKLGIASRAEIEDWFTAETLGVSGTMDLLDWSSLIDSR

SEQ ID NO: 66912 - protein, 492 aa, Homo sapiens; identical to SEQ ID NO: 66908
  Payload ID: 13338
  Gene Symbol: PRODH
  Gene Name: proline dehydrogenase (oxidase) 1
  ENSP ID: ENSP00000410805

SEQ ID NO: 66913 - protein, 164 aa, Homo sapiens
  Payload ID: 13338
  Gene Symbol: PRODH
  Gene Name: proline dehydrogenase (oxidase) 1
  ENSP ID: ENSP00000413941
  MOD_RES (1)..(1): Any amino acid
XRAAPLHSPLRPAVHGAGLPRAARSGPSGRARRWVGHGSAAAGARRGLRQRAGGVPQPANLGAGAEPAGAALVRLARAAGAPRAGPAPQLRRGMAVARISGTSNTRPTGPSGTAGMVSSVPAPTSTPMRPSATATWRHSCAASKPQLQFSEVLAKWRCFFHQMA

SEQ ID NO: 66914 - protein, 600 aa, Homo sapiens; identical to SEQ ID NO: 66909
  Payload ID: 13338
  Gene Symbol: PRODH
  Gene Name: proline dehydrogenase (oxidase) 1
  ENSP ID: ENSP00000480347

SEQ ID NO: 66915 - protein, 536 aa, Homo sapiens
  Payload ID: 13339
  Gene Symbol: PRODH2
  Gene Name: proline dehydrogenase (oxidase) 2
  Uniprot ID: Q9UF12
  ENSP ID: ENSP00000301175
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 66916 - protein, 119 aa, Homo sapiens
  Payload ID: 13339
  Gene Symbol: PRODH2
  Gene Name: proline dehydrogenase (oxidase) 2
  ENSP ID: ENSP00000465214
  MOD_RES (1)..(1): Any amino acid
XSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRAGRLCSV

SEQ ID NO: 66917 - protein, 73 aa, Homo sapiens
  Payload ID: 13339
  Gene Symbol: PRODH2
  Gene Name: proline dehydrogenase (oxidase) 2
  ENSP ID: ENSP00000474199
EATSQSYSRCLELMLTHVARHGPMCHLMVASHNEESVRQATKRMWELGIPLDGTVCFGQLLGMCDHVSLALGM

SEQ ID NO: 66918 - protein, 360 aa, Homo sapiens
  Payload ID: 13340
  Gene Symbol: PRR11
  Gene Name: proline rich 11
  Uniprot ID: Q96HE9
  ENSP ID: ENSP00000262293
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPTPTLPLSTSSFDEQN

SEQ ID NO: 66919 - protein, 144 aa, Homo sapiens
  Payload ID: 13340
  Gene Symbol: PRR11
  Gene Name: proline rich 11
  ENSP ID: ENSP00000463292
MGHCSLKLLCSREPPASPFRVARTIEIMPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQ

SEQ ID NO: 66920 - protein, 360 aa, Homo sapiens; identical to SEQ ID NO: 66918
  Payload ID: 13340
  Gene Symbol: PRR11
  Gene Name: proline rich 11
  Uniprot ID: Q96HE9
  ENSP ID: ENSP00000463733

SEQ ID NO: 66921 - protein, 53 aa, Homo sapiens
  Payload ID: 13340
  Gene Symbol: PRR11
  Gene Name: proline rich 11
  ENSP ID: ENSP00000463871
  MOD_RES (1)..(1): Any amino acid
XKSQMDLRKLLRKVDVERSPGGTPLTNKENMETGTGLTPVMTQALRRKFQVTL

SEQ ID NO: 66922 - protein, 199 aa, Homo sapiens
  Payload ID: 13340
  Gene Symbol: PRR11
  Gene Name: proline rich 11
  ENSP ID: ENSP00000464048
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPP

SEQ ID NO: 66923 - protein, 360 aa, Homo sapiens; identical to SEQ ID NO: 66918
  Payload ID: 13340
  Gene Symbol: PRR11
  Gene Name: proline rich 11
  Uniprot ID: Q96HE9
  ENSP ID: ENSP00000464171

SEQ ID NO: 66924 - protein, 22 aa, Homo sapiens
  Payload ID: 13340
  Gene Symbol: PRR11
  Gene Name: proline rich 11
  ENSP ID: ENSP00000464392
MPKFKQRRRKLKAKAERLFKKK

SEQ ID NO: 66925 - protein, 360 aa, Homo sapiens; identical to SEQ ID NO: 66918
  Payload ID: 13340
  Gene Symbol: PRR11
  Gene Name: proline rich 11
  Uniprot ID: Q96HE9
  ENSP ID: ENSP00000481852

SEQ ID NO: 66926 - protein, 2036 aa, Homo sapiens
  Payload ID: 13341
  Gene Symbol: PRR12
  Gene Name: proline rich 12
  Uniprot ID: Q9ULL5
  ENSP ID: ENSP00000394510
MDRNYPSAGFGDPLGAGAGWSYERSAKASLVYGSSRTSHPETDILHRQAYAAPHPLQSYATNHHPAGLSGLFDTGLHHAGSAGPDASVMNLISALESRGPQPGPSASSLLSQFRSPSWQTAMHTPGPTELFISGALPGSSTFPSSSALSAYQHPASFGSRPFPVPSSLSLQDPPFSPPANGLLSPHDVLHLKPSQAPTVPSSLGFERLAGGGVLGPAGLGPAQTPPYRPGPPDPPPPPRHLPTQFNLLASSSAAAAAAEQSSPQLYNFSGAAPGPPPPERALPRQDTVIKHYQRPASAQPPPPPPPAHALQHYLSCGGSYPSMGHRANLACSPLGGGEPSPGAGEPSKAGPSGATAGASGRATGPEAAGGGGAGGGGGGYRPIIQSPGYKTGKGGYGAAAGGATRPPPPRSTATPKCQSLGGPAAAYATGKASGAGGAGGQAYSPGQPQGLLGPQAYGQGFGGGQAQDLSKAPSYSGGPPQPPSGPPPPGLATCQSYSPDQLQGQLYGVQGEPYPGPAAHSQGLPTASPSLSYSTGHSPALSGHGGGWGPSSLGGGGEASPSHIIRPLQSPPATGRPPGVGSPGAPGKYLSSVLASAPFLAPPGAGSYAAGAGGYKGKGDGSELLAGPGGPPAERTEDEEFLIQHLLQAPSPPRTSGADGLVGEDGAADASKGLGGSGGAGGPPGTPYELAKEDPQRYHLQSVIRTSASLDEGATAALELGLGRLKEKKKGPERGGETPEGLATSVVHYGAGAKELGAFLQKSPPPPPPTAQSTQPTPHGLLLEAGGPDLPLVLPPPPPQLLPSVLSHAPSPSPSASKVGVHLLEPATRDGAPQPPPPPPPPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 66927 - protein, 1215 aa, Homo sapiens
  Payload ID: 13341
  Gene Symbol: PRR12
  Gene Name: proline rich 12
  Uniprot ID: Q9ULL5
  ENSP ID: ENSP00000478000
MEQLPGVPPGPPHPVRPPPPPPPPMPLQLEAHLRSHGLEPAAPSPRLRPEESLDPPGAMQELLGALEPLPPAPGDTGVGPPNSEGKDPAGAYRSPSPQGTKAPRFVPLTSICFPDSLLQDEERSFFPTMEEMFGGGAADDYGKAGPPEDEGDPKAGAGPPPGPPAYDPYGPYCPGRASGAGPETPGLGLDPNKPPELPSTVNAEPLGLIQSGPHQAAPPPPPPPPPPPAPASEPKGGLTSPIFCSTKPKKLLKTSSFHLLRRRDPPFQTPKKLYAQEYEFEADEDKADVPADIRLNPRRLPDLVSSCRSRPALSPLGDIDFCPPNPGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPEPPLLEEKPPPTPPPAPTPQPQPPPPPPPPQPALPSPPPLVAPTPSSPPPPPLPPPPPPAMPSPPPPPPPAAAPLAAPPEEPAAPSPEDPELPDTRPLHLAKKQETAAVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 66928 - protein, 98 aa, Homo sapiens
  Payload ID: 13342
  Gene Symbol: PRR13
  Gene Name: proline rich 13
  Uniprot ID: Q9NZ81
  ENSP ID: ENSP00000369112
MWNPNAGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 66929 - protein, 148 aa, Homo sapiens
  Payload ID: 13342
  Gene Symbol: PRR13
  Gene Name: proline rich 13
  Uniprot ID: Q9NZ81
  ENSP ID: ENSP00000412064
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 66930 - protein, 55 aa, Homo sapiens
  Payload ID: 13342
  Gene Symbol: PRR13
  Gene Name: proline rich 13
  ENSP ID: ENSP00000446691
MWNPNAGQPGPNPYPPNIGCPGGSNPAHPPPINPPFPPGPCPPPPGAPHGNPAFP

SEQ ID NO: 66931 - protein, 162 aa, Homo sapiens
  Payload ID: 13342
  Gene Symbol: PRR13
  Gene Name: proline rich 13
  ENSP ID: ENSP00000446818
MGYLDSIGWRTHLNMWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 66932 - protein, 148 aa, Homo sapiens; identical to SEQ ID NO: 66929
  Payload ID: 13342
  Gene Symbol: PRR13
  Gene Name: proline rich 13
  Uniprot ID: Q9NZ81
  ENSP ID: ENSP00000447777

SEQ ID NO: 66933 - protein, 151 aa, Homo sapiens
  Payload ID: 13342
  Gene Symbol: PRR13
  Gene Name: proline rich 13
  ENSP ID: ENSP00000447940
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKVSTLWRLAREGVPPQRD

SEQ ID NO: 66934 - protein, 98 aa, Homo sapiens; identical to SEQ ID NO: 66928
  Payload ID: 13342
  Gene Symbol: PRR13
  Gene Name: proline rich 13
  Uniprot ID: Q9NZ81
  ENSP ID: ENSP00000448153

SEQ ID NO: 66935 - protein, 116 aa, Homo sapiens
  Payload ID: 13342
  Gene Symbol: PRR13
  Gene Name: proline rich 13
  ENSP ID: ENSP00000448481
MWNPNAGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 66936 - protein, 148 aa, Homo sapiens; identical to SEQ ID NO: 66929
  Payload ID: 13342
  Gene Symbol: PRR13
  Gene Name: proline rich 13
  Uniprot ID: Q9NZ81
  ENSP ID: ENSP00000448761

SEQ ID NO: 66937 - protein, 58 aa, Homo sapiens
  Payload ID: 13342
  Gene Symbol: PRR13
  Gene Name: proline rich 13
  ENSP ID: ENSP00000449513
MWNPNAARVSRMPTVGSLPSSIPTACPWNPSCESLGSWHGWTSSDSRQEDAEENEESS

SEQ ID NO: 66938 - protein, 52 aa, Homo sapiens
  Payload ID: 13342
  Gene Symbol: PRR13
  Gene Name: proline rich 13
  ENSP ID: ENSP00000450334
MWNPNAVIVDKKMQKKMKKAHKKMHKHQKHHKYHKHGKHSSSSSSSSSSDSD

SEQ ID NO: 66939 - protein, 585 aa, Homo sapiens
  Payload ID: 13343
  Gene Symbol: PRR14
  Gene Name: proline rich 14
  Uniprot ID: Q9BWN1
  ENSP ID: ENSP00000300835
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLSPWGLAPLFRSVRSKLESFADIFLTPNKTPQPPPPSPPMKLELKIAISEAEQSGAAEGTASVSPRPPIRQWRTQDHNTPALLPKPSLGRSYSCPDLGPPGPGTCTWPPAPPQPSRPRPRRHTVGGGEMARAPPPPRPCLRKEVFPLGGVGASPSLTTSCSSTASTSFSEPAEPRLGSTKGKEPRASKDQVLSEPETKTMGKVSRFRIRRTPARPQLNLTPMGLPRPIRLNKKEFSLEEIYTNKNYQSPTTRRTFETIFEEPRERNGTLIFTSSRKLRRAVEFRDSSLPRSRRPSRGVRAAGGRTVPPNVAPSPDVGPLLQQRLEELDALLLEEETVDREQPHWT

SEQ ID NO: 66940 - protein, 585 aa, Homo sapiens; identical to SEQ ID NO: 66939
  Payload ID: 13343
  Gene Symbol: PRR14
  Gene Name: proline rich 14
  Uniprot ID: Q9BWN1
  ENSP ID: ENSP00000441641

SEQ ID NO: 66941 - protein, 242 aa, Homo sapiens
  Payload ID: 13343
  Gene Symbol: PRR14
  Gene Name: proline rich 14
  ENSP ID: ENSP00000454789
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQARPPDPLCLCREPLSRIHRTSSTLRRRSRTTPGPEEGPSQKVDRAPQPTLVVMLEDIASPRPPAEGFIDETPNFIIPAQRAEPMRIVRQPTPPPGDLEPPFQPSALPADPLESPPTAPDPALELPSTPPPSSLLRPRLS

SEQ ID NO: 66942 - protein, 104 aa, Homo sapiens
  Payload ID: 13343
  Gene Symbol: PRR14
  Gene Name: proline rich 14
  ENSP ID: ENSP00000455835
MDLPGDSSPPGQPRLCRQPLTRALWGARSPKRPRLQLPGAPSPLEKASRRVLAVVLEDVMAVHMVPVVPSKQTSIPQHHSYHQDPVHRQPPASPPRQAGWSSQA

SEQ ID NO: 66943 - protein, 2151 aa, Homo sapiens
  Payload ID: 13344
  Gene Symbol: PRR14L
  Gene Name: proline rich 14-like
  Uniprot ID: Q5THK1
  ENSP ID: ENSP00000331845
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLRSKEGNVQITAETLLKSAEVQGMKVNGTKTDNNEGHKNGNVSKDLSAGCGEFQEVDKIMTSDEVSETSTLVTPEPLTFVDPVLTEATPKEKECEELKSCPWLSLPGNSAISNVDNGKEELCKPNLVCEADDNHQQLHGHHNEQPSSTHDSPTATSPLKENSEVSCFTSDLSGPESRTISLENCGFEGGGLLKRSAEKTDSSYFYRGDDQGKNLASREENEERLLIPRSERGGPFLFNAREPEKEISGRCSGEKEPVVSPKENIHNNCIQDSLHTGNSSSLMPNSFTEATEVMLNKNDLKITVHVQGNLTNPEDHKETFTNMSHPGGHSEESSFSSLMQIEEAGQTTPVEPNILSKSFYTKDCNSLVSIQRNLEGNTQLNEASCNDFLFERKSIVSLMPEDQISPVSEVLKPKQGTALLLPSPEFDYRPESEKVIQTSHDDIPLLDEQSIACEMNELSCTNELVVNKVESECVLNQQVSLNSQEHANLPTDSLLHLNKEMPLATGRDAHQSHHPPLEGRADVIADIQTIPIQTKIKDISPPGNQTCGASSNCPTLNIKPVSLERKKEMADSGTKALHSRLRSNKREAAGFPQVVSVIECHSVQSQDISSCHRVRKNVSQENMCSASAAFKSSKISLQVDNSLITKYENAFQHRDHCCQGTGHSVEKSSCKVSYTSQERELDGKETNGSLPGDKIRNKMVAGLLNSGISNKTIHTSSSIKLSEEGLEGKEQDVSKETVFCKYNISDHAIQELNQTVNIPGPEKVLDQSPTVMFSSFKNVKSVETLDQKADEVLDCQSNQNRPDECKSEGQSAKEMLSSDQRETVTEPHGEVNHNQKDLLVSSGSNNSLPCGSPKKCNLKGAFVKMSGCDESTEGMVDIVYTDCSNKLAEGVLDVKASNLLDCGARQEKLAFQEDSRSTLSRRELDAAHTGTTGQDSDFPVTAASTVDFLKIKKSCEENVCRSLKDCEMEKCPDSCAHEMESVADHEPNKRILGRVNLSLNDSHYGQQDKGTSLRETQEMTEGSRLEPNSEFGKESTFGISSKESMSCHDESSVSLRSLKSIEIMPSQENSETNVNSEETDLKNLCKPKDGEMLCENVKDCTVLPEMKEIVSRDWSNSSDRDSVCTCVEKNACKACHPHENSSDRHLPLTVKTDIKVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEAEPEKRPKKVSQIRIRKTIPRPDPNLTPMGLPRPKRLKKKEFSLEEIYTNKNYKSPPANRCLETIFEEPKERNGTLISISQQKRKRVLEFQDFTVPRKRRARGKVKVAGSFTRAQKAAVQSRELDALLIQKLMELETFFAKEEEQEQSSGC

SEQ ID NO: 66944 - protein, 452 aa, Homo sapiens
  Payload ID: 13344
  Gene Symbol: PRR14L
  Gene Name: proline rich 14-like
  ENSP ID: ENSP00000332169
  MOD_RES (1)..(1): Any amino acid
XTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEAEPEKRPKKVSQIRIRKTIPRPDPNLTPMGLPRPKRLKKKEFSLEEIYTNKNYKSPPANRDLDSSCPSTDSETGHFLVFGYAQRQAQPHPLLASRRLIGCSSPEGRGHPRSYPYWRRLLVLCWYLPGWRAGRVTWLRLATWAGRGDSSL

SEQ ID NO: 66945 - protein, 675 aa, Homo sapiens
  Payload ID: 13344
  Gene Symbol: PRR14L
  Gene Name: proline rich 14-like
  ENSP ID: ENSP00000389527
KVKGEETEEHQRGRLGYLTVGEQSEELVTRETGDGDPVSNISQTHFKCRGILNHAEKQQSPEVLDYMLQKEEKYIRQQKAHTISQQCISSSLLLDDAQNQNQPKADKDESTMINEITLAKLAKDSIVAQTQKLEDQKEERLHHPLRKDTESCTSPCLLGAPRKAQDPSSAGCDQIHGAFAKKGVLPLKKQPHRTCKKVSYQEQIIVGRKIGKIRSSAFLKSSSNPIPTKAHRLLSLCTLSAPTRLEPETAPTKSLVSHIPKQMSTPCHPLRSLNFRKTTKESALLNKLSILASKLAPAMKTQKLRYRRCSSELLPMAKSYKRLRYKRLLDGFSSSTEQLNPYLAASGWDKRPNSKPMALYSLESIKMTFIDLSNKMPSLLFGSEIFPVSFHVKSSSSDCTTESSRTFPEHCAPARLALGEALQCPSQPPKWTFSFFLSHGCPGMATFREDTGVHSQTHTQAPPQPPAPLQDYGGTAIVQTRADCSVLGLHTLLALCSPGCYRIWTKKRSFSSHMPTMQRLFMTQFTQGLKGLRSPASIADKVFCSLPYSVGRVLSIWSQHGPSVCSFEISSLHSPHCKRQPSLGTTSSHTMLPYVPLPGMEATYNTSGSQTRLEPPFPALVPKSCLVAESAVSKLLLSASEFQVRGLDELDGVKAACPCPQSSPPEQKEVKEEGV

SEQ ID NO: 66946 - protein, 208 aa, Homo sapiens
  Payload ID: 13344
  Gene Symbol: PRR14L
  Gene Name: proline rich 14-like
  ENSP ID: ENSP00000399381
  MOD_RES (1)..(1): Any amino acid
XEPPFPALVPKSCLVAESAVSKLLLSASEFQVRGLDELDGVKAACPCPQSSPPEQKEAEPEKRPKKVSQIRIRKTIPRPDPNLTPMGLPRPKRLKKKEFSLEEIYTNKNYKSPPANRCLETIFEEPKERNGTLISISQQKRKRVLEFQDFTVPRKRRARGKVKVAGSFTRAQKAAVQSRELDALLIQKLMELETFFAKEEEQEQSSGC

SEQ ID NO: 66947 - protein, 180 aa, Homo sapiens
  Payload ID: 13344
  Gene Symbol: PRR14L
  Gene Name: proline rich 14-like
  ENSP ID: ENSP00000411129
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLR

SEQ ID NO: 66948 - protein, 129 aa, Homo sapiens
  Payload ID: 13345
  Gene Symbol: PRR15
  Gene Name: proline rich 15
  Uniprot ID: Q8IV56
  ENSP ID: ENSP00000317836
MADSGDAGSSGPWWKSLTNSRKKSKEAAVGVPPPAQPAPGEPTPPAPPSPDWTSSSRENQHPNLLGGAGEPPKPDKLYGDKSGSSRRNLKISRSGRFKEKRKVRATLLPEAGRSPEEAGFPGDPHEDKQ

SEQ ID NO: 66949 - protein, 18 aa, Homo sapiens
  Payload ID: 13345
  Gene Symbol: PRR15
  Gene Name: proline rich 15
  ENSP ID: ENSP00000408158
MADSGDAGSSGPWWKSLT

SEQ ID NO: 66950 - protein, 103 aa, Homo sapiens
  Payload ID: 13346
  Gene Symbol: PRR15L
  Gene Name: proline rich 15-like
  Uniprot ID: Q9BU68
  ENSP ID: ENSP00000300557
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 66951 - protein, 281 aa, Homo sapiens
  Payload ID: 13347
  Gene Symbol: PRR16
  Gene Name: proline rich 16
  Uniprot ID: Q569H4
  ENSP ID: ENSP00000368869
MAQSGLTATSASQVQAILLPQPASVRHYAWVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 66952 - protein, 304 aa, Homo sapiens
  Payload ID: 13347
  Gene Symbol: PRR16
  Gene Name: proline rich 16
  Uniprot ID: Q569H4
  ENSP ID: ENSP00000385118
MSAKSKGNPSSSCPAEGPPAASKTKVKEQIKIIVEDLELVLGDLKDVAKELKEVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 66953 - protein, 251 aa, Homo sapiens
  Payload ID: 13347
  Gene Symbol: PRR16
  Gene Name: proline rich 16
  ENSP ID: ENSP00000405491
VVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 66954 - protein, 142 aa, Homo sapiens
  Payload ID: 13347
  Gene Symbol: PRR16
  Gene Name: proline rich 16
  ENSP ID: ENSP00000421256
MTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQ

SEQ ID NO: 66955 - protein, 234 aa, Homo sapiens
  Payload ID: 13347
  Gene Symbol: PRR16
  Gene Name: proline rich 16
  Uniprot ID: Q569H4
  ENSP ID: ENSP00000423446
MTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 66956 - protein, 295 aa, Homo sapiens
  Payload ID: 13348
  Gene Symbol: PRR18
  Gene Name: proline rich 18
  Uniprot ID: Q8N4B5
  ENSP ID: ENSP00000319590
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGTTAAGTSSGAGPCPDSAARFCLNLTPEAVLVIQKRHLEKQLLARPRRPFPSPSAEPRRLLAPCLPARAAGPRRGGPASDPDAPPTAGQGRRAPPPGAQLLHGGLQVPQLSPRPGALRPMLKVSLLNERHRYDDVEYEEEPEAVDEGLVRKCTEWLRGVESAAAARGRAGALDSRRHLSTL

SEQ ID NO: 66957 - protein, 116 aa, Homo sapiens
  Payload ID: 13348
  Gene Symbol: PRR18
  Gene Name: proline rich 18
  ENSP ID: ENSP00000433381
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGT

SEQ ID NO: 66958 - protein, 356 aa, Homo sapiens
  Payload ID: 13349
  Gene Symbol: PRR19
  Gene Name: proline rich 19
  Uniprot ID: A6NJB7
  ENSP ID: ENSP00000342709
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 66959 - protein, 356 aa, Homo sapiens; identical to SEQ ID NO: 66958
  Payload ID: 13349
  Gene Symbol: PRR19
  Gene Name: proline rich 19
  Uniprot ID: A6NJB7
  ENSP ID: ENSP00000445247

SEQ ID NO: 66960 - protein, 206 aa, Homo sapiens
  Payload ID: 13349
  Gene Symbol: PRR19
  Gene Name: proline rich 19
  ENSP ID: ENSP00000469298
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGV

SEQ ID NO: 66961 - protein, 235 aa, Homo sapiens
  Payload ID: 13349
  Gene Symbol: PRR19
  Gene Name: proline rich 19
  Uniprot ID: A6NJB7
  ENSP ID: ENSP00000472962
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGERPSCPCTPLSFVGSSSASLYASFLCARGQAWGL

SEQ ID NO: 66962 - protein, 221 aa, Homo sapiens
  Payload ID: 13350
  Gene Symbol: PRR20A
  Gene Name: proline rich 20A
  Uniprot ID: P86496
  ENSP ID: ENSP00000367164
MEEPRPSKRLRSMAPNQASGGPPPEPGCCVADPEGSVEADGPAQPAQPAKPIAYVKPFRRQPPARPESPPPAERGRRRGGSRRPGRGRGRRAGPRGDAGQRQGAEGLMAPDVHIQLDHHGEPGHQGEPEITETAAFSLSETGPPPGTVQEGPGPDVAQPELGFQEPPAAPGPQAVDWQPVLTLYPCIGFRALGDSAVLQVIQTPQGTYVQGVPVFLTDIAY

SEQ ID NO: 66963 - protein, 221 aa, Homo sapiens; identical to SEQ ID NO: 66962
  Payload ID: 13351
  Gene Symbol: PRR20B
  Gene Name: proline rich 20B
  Uniprot ID: P86481
  ENSP ID: ENSP00000367163

SEQ ID NO: 66964 - protein, 221 aa, Homo sapiens; identical to SEQ ID NO: 66962
  Payload ID: 13352
  Gene Symbol: PRR20C
  Gene Name: proline rich 20C
  Uniprot ID: P86479
  ENSP ID: ENSP00000438757

SEQ ID NO: 66965 - protein, 221 aa, Homo sapiens; identical to SEQ ID NO: 66962
  Payload ID: 13352
  Gene Symbol: PRR20C
  Gene Name: proline rich 20C
  Uniprot ID: P86479
  ENSP ID: ENSP00000480729

SEQ ID NO: 66966 - protein, 221 aa, Homo sapiens; identical to SEQ ID NO: 66962
  Payload ID: 13353
  Gene Symbol: PRR20D
  Gene Name: proline rich 20D
  Uniprot ID: P86480
  ENSP ID: ENSP00000392407

SEQ ID NO: 66967 - protein, 221 aa, Homo sapiens; identical to SEQ ID NO: 66962
  Payload ID: 13354
  Gene Symbol: PRR20E
  Gene Name: proline rich 20E
  Uniprot ID: P86478
  ENSP ID: ENSP00000404281

SEQ ID NO: 66968 - protein, 389 aa, Homo sapiens
  Payload ID: 13355
  Gene Symbol: PRR21
  Gene Name: proline rich 21
  Uniprot ID: Q8WXC7
  ENSP ID: ENSP00000386166
MHACSSTALHPRPFIHGFSFTTFLQQLFPHGSSTALHPWPFIHGSSPMALHPRLFTHGPSSTALHPCPFTHGSSPMSLHPRLFTHSPSSMPLHPRPFVHASSPTALRPCLFTHGPSSMPLHPRPFVHASSPTALPPCLFTHGPSSMPLHPRPFLHASSPTALPPCLFTHGPSSMPLHPRPFVHASSPTALRPCLFTHGPSSMPLHPRPFVHASSPTALPPCLFTHGPSSMPLHPRPFVHASSPTALRPCLFTHGPSSMPLHPRPFLHASSPTALRPCLFTHGPSSMPLHPRPFVHASSPTALRPCLFTHGPSSMPLHPRPFVHASSSTSLHPRPFIHASSSKSLHLRLFSHSSCLVGFSQQGNVLLLSARATFNTCLLVSNMYFLIISY

SEQ ID NO: 66969 - protein, 422 aa, Homo sapiens
  Payload ID: 13356
  Gene Symbol: PRR22
  Gene Name: proline rich 22
  Uniprot ID: Q8IZ63
  ENSP ID: ENSP00000407653
MQHPKPFCAPAAPQEGFSPQSLEGAEVLGNQPAPTCAEPPPAMGSLNLYHPPDPEKEVFPAPPAGFQMAPCGCFFDPRIYRIEWTTPDLGQSALYKLAASSGGPAGVPSAPGSYLLEPQPYLKAPGLPPYPHYQQAPGGPQFLLPYFPPEGPGPEALGFVGDAGPAAFVELPLPPLEEGPAPLPPPPPKENKPPPVLITLPAEPTLPPDAYSHLQGHLGHFPGPEPLAFPVKELQGSGARPGVPLYPPGLSELKVAEVKEGALLGAGKAKAPKTARALALPDKVLLEDAMKLFDCLPGASEPEGTLCEVPGPALPDSSGGNSADDIRSLCLPEELLSFDYSVPEILDTVSNVDYFFNFKALDEEQPPHPGPPATNTPAPILSGKRKASTAKKGKPGRKARQPAGPASATPPGPREDLGATPH

SEQ ID NO: 66970 - protein, 82 aa, Homo sapiens
  Payload ID: 13356
  Gene Symbol: PRR22
  Gene Name: proline rich 22
  ENSP ID: ENSP00000465256
  MOD_RES (1)..(1): Any amino acid
XLEGAEVLGNQPAPTCAEPPPAMGTIGWVGAPAGEGSGAHPPKGPTHLGTFVHRLLEPVSSPRPRERGVSSPTSRYRPPLSP

SEQ ID NO: 66971 - protein, 279 aa, Homo sapiens
  Payload ID: 13357
  Gene Symbol: PRR23D1
  Gene Name: proline rich 23 domain containing 1
  Uniprot ID: E9PI22
  ENSP ID: ENSP00000436891
MYGYRRLRSPRDSQTEPQNDNEGETSLATTQMNPPKRRQVEQGPSTGAKKPSISGAPHLNSYQSLELPQNQQDSGTEELMIVLEQGTEVRLSLEEVILILAPETVLQLTLENTVLVIVPEHVLRSEDGLQSPVQIQYIIPSVDDFSLEFHAQDGDISDMRRENVPFSPAEEGKAAPLYQQPLMIPQANHMAGISPSFLVTPLCIPRCRAAFPQCYPLPPTPSPVGRPRPADSSFSLHGMELLCTSSLRPMPPSPSPGPQVYHRVHHRPPSRARRCLFRK

SEQ ID NO: 66972 - protein, 279 aa, Homo sapiens; identical to SEQ ID NO: 66971
  Payload ID: 13357
  Gene Symbol: PRR23D1
  Gene Name: proline rich 23 domain containing 1
  Uniprot ID: E9PI22
  ENSP ID: ENSP00000480164

SEQ ID NO: 66973 - protein, 279 aa, Homo sapiens; identical to SEQ ID NO: 66971
  Payload ID: 13358
  Gene Symbol: PRR23D2
  Gene Name: proline rich 23 domain containing 2
  Uniprot ID: P0DMB1
  ENSP ID: ENSP00000436580

SEQ ID NO: 66974 - protein, 266 aa, Homo sapiens
  Payload ID: 13359
  Gene Symbol: PRR23A
  Gene Name: proline rich 23A
  Uniprot ID: A6NEV1
  ENSP ID: ENSP00000372649
MGSRPRSPSAFPAPWWGQQPGGPGPAKRLRLEEPAGPEPRVAPSLEDPAGTPAVGALTSIVVLAAGCALRVPLDDVDLVLELPPTSILRVSLDGHTLILIPEVLLSSVDERSGAQDDSSAGLEVDVFLGALREDVVVEQEVFCASVPEIAAQEEAYEEDADPEFPELQMDSAAGSAAGLYSSARSMFSPYREGPIPEPCALAPNPSSEGHSPGPFFDPEFRLLEPVPSSPLQPLPPSPRVGSPGPHAHPPLPKRPPCKARRRLFQE

SEQ ID NO: 66975 - protein, 265 aa, Homo sapiens
  Payload ID: 13360
  Gene Symbol: PRR23B
  Gene Name: proline rich 23B
  Uniprot ID: Q6ZRT6
  ENSP ID: ENSP00000328768
MVSRPRSPSAFPAPWWGQQPGGPGPAKRLRLEEPAGPEPRAAPSLEDPAGDPAVDALTSIVVLAAGCALRVPLDDVDLVLEPAPTSILRVSLGGHTLILIPEVLLSSVDERSGAQHDSSAGLEVDVFLGAVREDVVVELEFCASVPEIAAQEEAYEEDADPEFPELRMDSPTGSAAGLYPSSRSMFIPYREGPIPEPCALAPNPSSERRSPRPIFDLEFRLLEPVPSSPLQPLPPSPCVGSPGPHARSPLPERPPCKARRRLFQA

SEQ ID NO: 66976 - protein, 262 aa, Homo sapiens
  Payload ID: 13361
  Gene Symbol: PRR23C
  Gene Name: proline rich 23C
  Uniprot ID: Q6ZRP0
  ENSP ID: ENSP00000396648
MGSRPCSPSACLAPWWGQQPGGPGPAKRSRLEEPAGPESRAAPSPEDPAGTPAVDALTSMVVLDAGCALRVPLEDVDLVLELAPMSVLRVSLGGHTLIVIPEVLLSSVDECSGAQGDWSAGLEVDVFLGAHGEDVVVEQEVCASVPEIAAEEEAYEEDADSEFPELWMDSAAGSAAGLYPSARSMFSPYREGPIRGPCALAPNPSSERRSPRPIFDLEFHLLEPVPSSPLQPLPPSPSPGPHARPELPERPPCKVRRRLFQE

SEQ ID NO: 66977 - protein, 402 aa, Homo sapiens
  Payload ID: 13362
  Gene Symbol: PRR25
  Gene Name: proline rich 25
  Uniprot ID: Q96S07
  ENSP ID: ENSP00000301698
MARTDQKPPCRGGCWGQPGHPNTGGAAAHPTYHPMGHRPRTCILLRGDQTTGGQAPSREISLGPWAAGTHFLAISTTPWGRKTPACISELPTSSGTAQPLANAVCEVQTVPGPGLRPQGTPAMRAPSHKGTPPTPNPWGPEQPQNRHKHPKKGVTGGPSPPPPAASRYGQTPGREPRVQAPGLGPCGRPASGRLLSLHLEKGDGKGTRQRIPLTDAAVGGDRTDIPSAIAAGPARTPDRHGLPIPGSTPTPMVGSGRLGAPVGRSGGGASARSSRPSCANVLLRADASLGTVLSVLWTGQLSRGWALLPPGDAGRHLETSVISAGVAAGIWLVEPGEAAQDPATRRTAPPRRTASPEPPAPGAPLPACPGRIPGAARFGPRSCPLGSPAVLAVTTGWSHRSV

SEQ ID NO: 66978 - protein, 198 aa, Homo sapiens
  Payload ID: 13363
  Gene Symbol: PRR26
  Gene Name: proline rich 26
  ENSP ID: ENSP00000370899
MESSRWDKDPPGERRPQQSQHWRSCGVGGAGEATRGGLFPVPFPSGDSWPEVTQHWMRFQGQGPWCPGLWTTPAHSHCKPQTGAVDNASPRQPHAPDQHEKNAGRQHLHLWSLACPPWLHSIPHIKGTILSEALSGFLVSDRRTKTVAGLRWLWLRKEATPTASRTTLSSSLAPRGRGVNTLGRGGCTLMVLSSDLCD

SEQ ID NO: 66979 - protein, 221 aa, Homo sapiens
  Payload ID: 13363
  Gene Symbol: PRR26
  Gene Name: proline rich 26
  Uniprot ID: Q8N8Z3
  ENSP ID: ENSP00000414034
MESSRWDKDPPGERRPQQSQHWRARDHGARGCGPRQPTATASPRPGLWITPAHGSHTPQTNTRRTQADNIFIYESWLIHHGTQMSSVLPQPPLVRGPWHNTNSPWDSWASRGKLRVCPCRTPRLHSSGCFSSKAGTALSPSLPVPGLRPQPPFLQKPLSILAPATPPALVSPTPPKLSPGQLSPHSVNVHWGPQGHLHLPRSGTTVLHAYLQTLSSPASHQ

SEQ ID NO: 66980 - protein, 219 aa, Homo sapiens
  Payload ID: 13364
  Gene Symbol: PRR27
  Gene Name: proline rich 27
  Uniprot ID: Q6MZM9
  ENSP ID: ENSP00000343172
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAAGAPVAAEPAAEAPVGAEPAAEAPVAAEPAAEAPVGVEPAAEEPSPAEPATAKPAAPEPHPSPSLEQANQ

SEQ ID NO: 66981 - protein, 26 aa, Homo sapiens
  Payload ID: 13364
  Gene Symbol: PRR27
  Gene Name: proline rich 27
  ENSP ID: ENSP00000421286
MKLLLWACIVCVAFARKNAGLGFLWL

SEQ ID NO: 66982 - protein, 61 aa, Homo sapiens
  Payload ID: 13364
  Gene Symbol: PRR27
  Gene Name: proline rich 27
  ENSP ID: ENSP00000421773
  MOD_RES (1)..(1): Any amino acid
XAEAPVGAEPAAEAPVAAEPAAEAPVGVEPAAEEPSPAEPATAKPAAPEPHPSPSLEQANQ

SEQ ID NO: 66983 - protein, 219 aa, Homo sapiens; identical to SEQ ID NO: 66980
  Payload ID: 13364
  Gene Symbol: PRR27
  Gene Name: proline rich 27
  Uniprot ID: Q6MZM9
  ENSP ID: ENSP00000426249

SEQ ID NO: 66984 - protein, 219 aa, Homo sapiens; identical to SEQ ID NO: 66980
  Payload ID: 13364
  Gene Symbol: PRR27
  Gene Name: Proline rich 27
  ENSP ID: ENSP00000489097

SEQ ID NO: 66985 - protein, 219 aa, Homo sapiens; identical to SEQ ID NO: 66980
  Payload ID: 13364
  Gene Symbol: PRR27
  Gene Name: Proline rich 27
  ENSP ID: ENSP00000489399

SEQ ID NO: 66986 - protein, 61 aa, Homo sapiens; identical to SEQ ID NO: 66982
  Payload ID: 13364
  Gene Symbol: PRR27
  Gene Name: Proline rich 27
  ENSP ID: ENSP00000489408
  MOD_RES (1)..(1): Any amino acid

SEQ ID NO: 66987 - protein, 26 aa, Homo sapiens
  Payload ID: 13364
  Gene Symbol: PRR27
  Gene Name: Proline rich 27
  ENSP ID: ENSP00000489521
MKLLLWACIVCVAFARKNAGLGFLWL

SEQ ID NO: 66988 - protein, 236 aa, Homo sapiens
  Payload ID: 13365
  Gene Symbol: PRR29
  Gene Name: proline rich 29
  Uniprot ID: P0C7W0
  ENSP ID: ENSP00000396936
MASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASRERETTMMPRASYEDRPRPWELHQLPALDTAPEPPPAPLLSTPRCPWLAVLLTPSTSARPSSPGEISPCPTPMSSWTGRICAVV

SEQ ID NO: 66989 - protein, 189 aa, Homo sapiens
  Payload ID: 13365
  Gene Symbol: PRR29
  Gene Name: proline rich 29
  Uniprot ID: P0C7W0
  ENSP ID: ENSP00000400986
MASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASREREVRAVPPPPPPSATGTVGADVPPASDYYDAESLL

SEQ ID NO: 66990 - protein, 37 aa, Homo sapiens
  Payload ID: 13365
  Gene Symbol: PRR29
  Gene Name: proline rich 29
  ENSP ID: ENSP00000461973
MASGAGGSWGRSPPQSAVPTESCAPTPTPQCHRDCGC

SEQ ID NO: 66991 - protein, 182 aa, Homo sapiens
  Payload ID: 13365
  Gene Symbol: PRR29
  Gene Name: proline rich 29
  Uniprot ID: P0C7W0
  ENSP ID: ENSP00000462097
MASGAGGSWGRSPPQSAVPTPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASREREVRAVPPPPPPSATGTVGADVPPASDYYDAESLL

SEQ ID NO: 66992 - protein, 156 aa, Homo sapiens
  Payload ID: 13365
  Gene Symbol: PRR29
  Gene Name: proline rich 29
  ENSP ID: ENSP00000462130
MASGAGGSWGRSPPQSAVPTPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASRERETTMMPRA

SEQ ID NO: 66993 - protein, 98 aa, Homo sapiens
  Payload ID: 13365
  Gene Symbol: PRR29
  Gene Name: proline rich 29
  Uniprot ID: P0C7W0
  ENSP ID: ENSP00000463279
MASGAGGSWGRSPPQSAVPTPWVTFLQPLSWAVPPAPPQPGRVKEDLLELMMLQNAQMHQLLLSRLVAGALQPRPASPCPQESCAPTPTPQCHRDCGC

SEQ ID NO: 66994 - protein, 138 aa, Homo sapiens
  Payload ID: 13365
  Gene Symbol: PRR29
  Gene Name: proline rich 29
  ENSP ID: ENSP00000464103
MLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASREREVRAVPPPPPPSATGTVGADVPPASDYYDAESLL

SEQ ID NO: 66995 - protein, 167 aa, Homo sapiens
  Payload ID: 13366
  Gene Symbol: PRR3
  Gene Name: proline rich 3
  Uniprot ID: P79522
  ENSP ID: ENSP00000365740
MPKRKKQNHHQPPTQQQPPLPEREETGDEEDGSPIALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 66996 - protein, 188 aa, Homo sapiens
  Payload ID: 13366
  Gene Symbol: PRR3
  Gene Name: proline rich 3
  Uniprot ID: P79522
  ENSP ID: ENSP00000365744
MPKRKKQNHHQPPTQQQPPLPEREETGDEEDGSPIGPPSLLGPPPMANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 66997 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000373086

SEQ ID NO: 66998 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000392826

SEQ ID NO: 66999 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000393410

SEQ ID NO: 67000 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000396416

SEQ ID NO: 67001 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000398352

SEQ ID NO: 67002 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000401499

SEQ ID NO: 67003 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000401612

SEQ ID NO: 67004 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000402596

SEQ ID NO: 67005 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000404669

SEQ ID NO: 67006 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000406321

SEQ ID NO: 67007 - protein, 167 aa, Homo sapiens; identical to SEQ ID NO: 66995
  Payload ID: 13366
  Gene Symbol: PRR3
  Gene Name: proline rich 3
  Uniprot ID: P79522
  ENSP ID: ENSP00000411802

SEQ ID NO: 67008 - protein, 188 aa, Homo sapiens; identical to SEQ ID NO: 66996
  Payload ID: 13366
  Gene Symbol: PRR3
  Gene Name: proline rich 3
  Uniprot ID: P79522
  ENSP ID: ENSP00000415432

SEQ ID NO: 67009 - protein, 412 aa, Homo sapiens
  Payload ID: 13367
  Gene Symbol: PRR30
  Gene Name: proline rich 30
  Uniprot ID: Q53SZ7
  ENSP ID: ENSP00000335017
MLPQNKDQVLPQTSVLPGRPTWGFSQLVDSSPHNLQPLSPHQGLPPSQPPFSSTQSRRPSSPPPASPSPGFQFGSCDSNSDFAPHPYSPSLPSSPTFFHQNYLSLPRPRASSPSNHWLYPSPPLTPSFSPSQPQNSSLPHSPCQSPSHPEELHSSTLTSPGPSPPSHRLHSNRQTWRWHQYRDTGSGSPGVVERCVPSEKDPAQFRDPGALAQALVVQLGHRRIAHDLRLLLLQHLWLGRTGQAPVVEYPICLVCLRPRSPSCPLPRYRTGPRLLAFPQLLPCVQGQESGPLRIGIGFGLRLPQGQARALHLLPEKRPKEAGPQGKATQACGHQLPASQPPAAQARADPVPGTPSQTRSFRSAGLQSPNSPRCFSGPPPRAPKQVTTSLKPRPCPGPKRPVSLELILQKSSV

SEQ ID NO: 67010 - protein, 104 aa, Homo sapiens
  Payload ID: 13367
  Gene Symbol: PRR30
  Gene Name: proline rich 30
  ENSP ID: ENSP00000393468
MLPQNKDQADMALASVQGHWVRVPWSGGEMRAKREGSCTVQGPRGPGPGPGGPAGAPPHRTRPAATAFAAPVARQNRPGPSRGVSYMPGVPPAPQPLLPPPQVQ

SEQ ID NO: 67011 - protein, 298 aa, Homo sapiens
  Payload ID: 13368
  Gene Symbol: PRR32
  Gene Name: proline rich 32
  Uniprot ID: B1ATL7
  ENSP ID: ENSP00000360166
MACIENVLGGHAPSPLVVSVDKNGNQELHHDMPLQCLSSKPEDDAEPWGQPQVPLRPSVNVLTDLDSKQLEWPSERTGSCIPLHSLRAHRHPYGPPPAVAEESLATAEVNSSDALAGWRQEGQDAINVSWEVSGGPPALIVGGTKVNNGGTERGSNNARLHVALPQGKGFFPPRGPQVRGPSHIPTLRSGIVMEVPPGNTRIACRGKLAHVSFPLRGPCHPMHNWPRPIPLSSSTPGLPSCSTVHCFIPPRPPIFNPFLTMPLPFAPPPIFGPPLPSYFAHFHSGGMPAPASPNREHS

SEQ ID NO: 67012 - protein, 479 aa, Homo sapiens
  Payload ID: 13369
  Gene Symbol: PRR33
  Gene Name: proline rich 33
  Uniprot ID: A8MZF0
  ENSP ID: ENSP00000375311
MLISAASMAPEVCGPSLQGTPGPPPPLLPKPGKDNLRLQKLLRKAARKKMMGGTHLAPPRAFRTSLSPVSEASHDQEVTAPHAAEGPHPAEAPRLPEAPRPAEAPRMVAALPRSPHTPIIHHVASPLQKSTFSIGLTQRRILAAQFRAMGPQVVASAPEPTRPPSGFVPVSGGGGTHVTQVHIQLAPSPHNGTPEPPRTAPEVGSNSQDGDATPSPPRAQPLVPVAHIRPLPTTVQAASPLPEEPPVPRPPPGFQASVPREASARVVVPIAPTCRSLESSPHSLVPMGPGREHLEEPPMAGPAAEAERVSSPAWASSPTPPSGPHPCPVPKVAPKPRLSGWTWLKKQLLEEAPEPPCPEPRQSLEPEVPTPTEQEVPAPTEQEVPALTAPRAPASRTSRMWDAVLYRMSVAEAQGRLAGPSGGEHTPASLTRLPFLYRPRFNARKLQEATRPPPTVRSILELSPQPKNFNRTATGWRLQ

SEQ ID NO: 67013 - protein, 138 aa, Homo sapiens
  Payload ID: 13370
  Gene Symbol: PRR34
  Gene Name: proline rich 34
  Uniprot ID: Q9NV39
  ENSP ID: ENSP00000379329
MPASATAAWHCPPLCLPPLPASAPTSPPNPATRPAPGPGRRARCPQSAHPAPTRGALTFWAPGSWPRVLLVPRSPGPVLRAPRLPHPAARARRRAWHGARLPGSPARAGRTFQRGLVSNSWAHAIFLPRPPNVLELQV

SEQ ID NO: 67014 - protein, 571 aa, Homo sapiens
  Payload ID: 13371
  Gene Symbol: PRR35
  Gene Name: proline rich 35
  Uniprot ID: P0CG20
  ENSP ID: ENSP00000386499
MSREAGSCRVGTGARARSRKPKKPHYIPRPWGKPYNYKCFQCPFTCLEKSHLYNHMKYSLCKDSLSLLLDSPDWACRRGSTTPRPHAPTPDRPGESDPGRQPQGARPTGAAPAPDLVVADIHSLHCGGGPKSRAKGSPGPPPPVARATRKGPGPSGLLPESWKPGMGGDPRGVGAGDMASAGPEGSVPCYPPPAPGEFPEAHSLHLSLLGVNYPLSPGLFSYLGPSLAAAAHVPFLASASPLLPPATAFPAVQPPQRPTPAPRLYYPLLLEHTLGLPAGKAALAKAPVSPRSPSGTPAPGLLKVPVPGLGPWPRVTPRDPGQEGELERAAQSDPRRRLSLGSRLELPKASPSLTRFCSRSSLPTGSSVMLWPEDGDPGGPETPGPEGPLPLQPRGPVPGSPEHVGEDLTRALGDYARVEQRLGQLGPAGGLAPRPLREQLGKIRLELLTIHQALEQAVRPPDAPLDLSVKRAPAKGPQALGEAWGRPELGPVLTGGTPEPPGMLGPAAPQPFSGHTTKCEADSSVPPPGLPLAAPDDPVIPGSGWGTCVATRSSQTPEAVCGLQSPQGAEV

SEQ ID NO: 67015 - protein, 1346 aa, Homo sapiens
  Payload ID: 13372
  Gene Symbol: PRR36
  Gene Name: proline rich 36
  Uniprot ID: Q9H6K5
  ENSP ID: ENSP00000482374
MDNKRDKAKAGAAARTPAARAPGLLTPRPPGSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRDTSGPTPGTPSPAMARRSRAAGTEVGLPRPAPSARPRPPTEGPRKSVSSASEHSTTEPSPAARRRPSAGGGLQRPASRSLSSSATPLSSPARSGPSARGTPRAPAHPSQPKPKGLQALRPPQVTPPRKDAAPALGPLSSSPLATPSPSGTKARPVPPPDNAATPLPATLPPSPPVTPPPPAALQSQAPPTLPATPHSSSLTCQLATPLPLAPPSPSAPPSLQTLPSPPATPPSQVPPTQLIMSFPEAGVSSLATAAFVASVSPSVSSPLQSMPPTQANPALPSLPTLLSPLATPPLSAMSPLQGPVSPATSLGNSAFPLAALPQPGLSALTTPPPQASPSPSPPSLQATPHTLATLPLQDSPLLATLPLQASPSPLTTVSLQDPPLVSPSLLASPPLQAPPHPQAPPSMTTPPMQAPPSLQTIPPIQVPHSLTSPSLQAPPSPLALSSLQATTSLGSPTLQATHSFLTMSPRQTQASLISPSRPASTPPDSPPLQAPLSLPASPPLQTSLSPAVSPLSSPLTIHPLQALSSLASHSPQAPLSSLIMPPLETQSSLAPPSLQTPPASLTTPPLENLPSLAPPPLQTASAPLTTPPLENLPSLAPPPLQTASAPLTTPHLETPPCPAPCPLQAPPSPLTTPPPETPSSIATPPPQAPPALASPPLQGLPSPPLSPLATPPPQAPPALALPPLQAPPSPPASPPLSPLATPSPQAPNALAVHLLQAPFSPPPSPPVQAPFSPPASPPVSPSATPPSQAPPSLAAPPLQVPPSPPASPPMSPSATPPPQAPPPLAAPPLQVPPSPPASPPMSPSATPPPRVPPLLAAPPLQVPPSPPASLPMSPLAKPPPQAPPALATPPLQALPSPPASFPGQAPFSPSASLPMSPLATPPPQAPPVLAAPLLQVPPSPPASPTLQAPRRPPTPGPDTSVSGPRLTLALAPGPPPPPSRSPSSTLSGPDLAGHSSSATSTPEELRGYDSGPEGGAAASPPPDAELAACHPAAWSRGPAPPLAFRGAPGAPLPWPPATGPGSADGLCTIYETEGPESATPAPGALDPGPSPGTSGGKAAAGAGAGASSRSPKQARLGELPLGALQASVVQHLLSRTLLLAAAEGAAGGSGGGPGGAEGGGVTGGARAALSDAELGRWAELLSPLDESRASITSVTSFSPDDVASPQGDWTVVEVETFH

SEQ ID NO: 67016 - protein, 275 aa, Homo sapiens
  Payload ID: 13372
  Gene Symbol: PRR36
  Gene Name: proline rich 36
  ENSP ID: ENSP00000485221
  MOD_RES (1)..(1): Any amino acid
XSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRARSGPSARGTPRAPAHPSQPKPKGLQALRPPQVTPPRKDAAPALGPLSSSPLATPSPSGTKPVQHAERPRPGRPQQQRHEHARGAAWLRQRARGRCRSLPAPRRRARRLPPGCLESRPRSAAGFPRSPRCAPAVASRYRTGLC

SEQ ID NO: 67017 - protein, 134 aa, Homo sapiens
  Payload ID: 13373
  Gene Symbol: PRR4
  Gene Name: proline rich 4 (lacrimal)
  Uniprot ID: Q16378
  ENSP ID: ENSP00000228811
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 67018 - protein, 65 aa, Homo sapiens
  Payload ID: 13373
  Gene Symbol: PRR4
  Gene Name: proline rich 4 (lacrimal)
  Uniprot ID: Q16378
  ENSP ID: ENSP00000438046
MLLVLLSVVLLALSSAQSTDNDVNYEDFTFTIPACRKHHHSSRGTDQQDIPRSNHSGNLEFSGRK

SEQ ID NO: 67019 - protein, 78 aa, Homo sapiens
  Payload ID: 13373
  Gene Symbol: PRR4
  Gene Name: proline rich 4 (lacrimal)
  ENSP ID: ENSP00000443939
MLLVLLSVVLLALSSAQSTDNDVNYEDFTFTIPATTTPTRTPSTLSTPISFCQPAGSIIILPEGQTSKTSPGATTLVI

SEQ ID NO: 67020 - protein, 134 aa, Homo sapiens; identical to SEQ ID NO: 67017
  Payload ID: 13373
  Gene Symbol: PRR4
  Gene Name: proline rich 4 (lacrimal)
  Uniprot ID: Q16378
  ENSP ID: ENSP00000459468

SEQ ID NO: 67021 - protein, 78 aa, Homo sapiens; identical to SEQ ID NO: 67019
  Payload ID: 13373
  Gene Symbol: PRR4
  Gene Name: proline rich 4 (lacrimal)
  ENSP ID: ENSP00000461332

SEQ ID NO: 67022 - protein, 65 aa, Homo sapiens; identical to SEQ ID NO: 67018
  Payload ID: 13373
  Gene Symbol: PRR4
  Gene Name: proline rich 4 (lacrimal)
  Uniprot ID: Q16378
  ENSP ID: ENSP00000461695

SEQ ID NO: 67023 - protein, 134 aa, Homo sapiens; identical to SEQ ID NO: 67017
  Payload ID: 13373
  Gene Symbol: PRR4
  Gene Name: proline rich 4 (lacrimal)
  Uniprot ID: Q16378
  ENSP ID: ENSP00000477689

SEQ ID NO: 67024 - protein, 147 aa, Homo sapiens
  Payload ID: 13373
  Gene Symbol: PRR4
  Gene Name: proline rich 4 (lacrimal)
  ENSP ID: ENSP00000481571
MWRGIDSIYPYELLQKNILPAGTCCIYSRVEVFTDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 67025 - protein, 166 aa, Homo sapiens
  Payload ID: 13373
  Gene Symbol: PRR4
  Gene Name: proline rich 4 (lacrimal)
  ENSP ID: ENSP00000482363
MLLILLSVALLAFSSAQDLNEDVSQEDVPLVISDGGDSEQFLDEERQGPPLGGQQSQPSAGDGNQDDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 67026 - protein, 65 aa, Homo sapiens; identical to SEQ ID NO: 67018
  Payload ID: 13373
  Gene Symbol: PRR4
  Gene Name: proline rich 4 (lacrimal)
  Uniprot ID: Q16378
  ENSP ID: ENSP00000487830

SEQ ID NO: 67027 - protein, 147 aa, Homo sapiens; identical to SEQ ID NO: 67024
  Payload ID: 13373
  Gene Symbol: PRR4
  Gene Name: proline rich 4 (lacrimal)
  ENSP ID: ENSP00000488385

SEQ ID NO: 67028 - protein, 78 aa, Homo sapiens; identical to SEQ ID NO: 67019
  Payload ID: 13373
  Gene Symbol: PRR4
  Gene Name: proline rich 4 (lacrimal)
  ENSP ID: ENSP00000488607

SEQ ID NO: 67029 - protein, 379 aa, Homo sapiens
  Payload ID: 13374
  Gene Symbol: PRR5
  Gene Name: proline rich 5 (renal)
  Uniprot ID: P85299
  ENSP ID: ENSP00000006251
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 67030 - protein, 388 aa, Homo sapiens
  Payload ID: 13374
  Gene Symbol: PRR5
  Gene Name: proline rich 5 (renal)
  Uniprot ID: P85299
  ENSP ID: ENSP00000337464
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 67031 - protein, 177 aa, Homo sapiens
  Payload ID: 13374
  Gene Symbol: PRR5
  Gene Name: proline rich 5 (renal)
  ENSP ID: ENSP00000384746
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGICPRQSGPVVMAPMPTGQKLLDSLAETWDFFFSDVLPMLQAIFYPVQGKEPSVRQLALLHFRNAITLSV

SEQ ID NO: 67032 - protein, 411 aa, Homo sapiens
  Payload ID: 13374
  Gene Symbol: PRR5
  Gene Name: proline rich 5 (renal)
  Uniprot ID: P85299
  ENSP ID: ENSP00000384848
MVCLELSQREAWGSGSPEKMPAQPEGLYRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 67033 - protein, 113 aa, Homo sapiens
  Payload ID: 13374
  Gene Symbol: PRR5
  Gene Name: proline rich 5 (renal)
  ENSP ID: ENSP00000392026
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEEAAGLTGRDLGLLLQ

SEQ ID NO: 67034 - protein, 267 aa, Homo sapiens
  Payload ID: 13374
  Gene Symbol: PRR5
  Gene Name: proline rich 5 (renal)
  ENSP ID: ENSP00000400925
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGT

SEQ ID NO: 67035 - protein, 122 aa, Homo sapiens
  Payload ID: 13374
  Gene Symbol: PRR5
  Gene Name: proline rich 5 (renal)
  ENSP ID: ENSP00000407637
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEEAAGLTGRDLGLLLQ

SEQ ID NO: 67036 - protein, 226 aa, Homo sapiens
  Payload ID: 13374
  Gene Symbol: PRR5
  Gene Name: proline rich 5 (renal)
  ENSP ID: ENSP00000410215
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLL

SEQ ID NO: 67037 - protein, 293 aa, Homo sapiens
  Payload ID: 13374
  Gene Symbol: PRR5
  Gene Name: proline rich 5 (renal)
  Uniprot ID: P85299
  ENSP ID: ENSP00000479623
MVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 67038 - protein, 379 aa, Homo sapiens; identical to SEQ ID NO: 67029
  Payload ID: 13374
  Gene Symbol: PRR5
  Gene Name: proline rich 5 (renal)
  Uniprot ID: P85299
  ENSP ID: ENSP00000480357

SEQ ID NO: 67039 - protein, 293 aa, Homo sapiens; identical to SEQ ID NO: 67037
  Payload ID: 13374
  Gene Symbol: PRR5
  Gene Name: proline rich 5 (renal)
  Uniprot ID: P85299
  ENSP ID: ENSP00000485597

SEQ ID NO: 67040 - protein, 368 aa, Homo sapiens
  Payload ID: 13375
  Gene Symbol: PRR5L
  Gene Name: proline rich 5 like
  Uniprot ID: Q6MZQ0
  ENSP ID: ENSP00000368144
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 67041 - protein, 49 aa, Homo sapiens
  Payload ID: 13375
  Gene Symbol: PRR5L
  Gene Name: proline rich 5 like
  ENSP ID: ENSP00000431475
MTRGFAPILPVEFHKMGSFRRPRPRFMSSPVLSDLPRFQAARQALQLSS

SEQ ID NO: 67042 - protein, 75 aa, Homo sapiens
  Payload ID: 13375
  Gene Symbol: PRR5L
  Gene Name: proline rich 5 like
  ENSP ID: ENSP00000431610
MTRGFAPILPVEFHKMGSFRRPRPRFMSSPVLSDLPRFQAARQALQLSSSSAWNSVQTAVINVFKGGGLQSNELY

SEQ ID NO: 67043 - protein, 75 aa, Homo sapiens; identical to SEQ ID NO: 67042
  Payload ID: 13375
  Gene Symbol: PRR5L
  Gene Name: proline rich 5 like
  ENSP ID: ENSP00000432203

SEQ ID NO: 67044 - protein, 48 aa, Homo sapiens
  Payload ID: 13375
  Gene Symbol: PRR5L
  Gene Name: proline rich 5 like
  ENSP ID: ENSP00000433305
MTRGFAPILPVEFHKMGSFRRPRPRFMSSPVLSDLPRFQAARQALQLS

SEQ ID NO: 67045 - protein, 47 aa, Homo sapiens
  Payload ID: 13375
  Gene Symbol: PRR5L
  Gene Name: proline rich 5 like
  ENSP ID: ENSP00000433708
MTRGFAPILPVEFHKMGSFRRPRPRFMSSPVLSDLPRFQAARQALQL

SEQ ID NO: 67046 - protein, 83 aa, Homo sapiens
  Payload ID: 13375
  Gene Symbol: PRR5L
  Gene Name: proline rich 5 like
  ENSP ID: ENSP00000433893
MTRGFAPILPVEFHKMGSFRRPRPRFMSSPVLSDLPRFQAARQALQLSSSSAWNSVQTAVINVFKGGGLQSNELYALNENIRR

SEQ ID NO: 67047 - protein, 368 aa, Homo sapiens; identical to SEQ ID NO: 67040
  Payload ID: 13375
  Gene Symbol: PRR5L
  Gene Name: proline rich 5 like
  Uniprot ID: Q6MZQ0
  ENSP ID: ENSP00000435050

SEQ ID NO: 67048 - protein, 205 aa, Homo sapiens
  Payload ID: 13375
  Gene Symbol: PRR5L
  Gene Name: proline rich 5 like
  Uniprot ID: Q6MZQ0
  ENSP ID: ENSP00000435241
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQPGGTPGSGPR

SEQ ID NO: 67049 - protein, 80 aa, Homo sapiens
  Payload ID: 13375
  Gene Symbol: PRR5L
  Gene Name: proline rich 5 like
  ENSP ID: ENSP00000436402
MTRGFAPILPVEFHKMGSFRRPRPRFMSSPVLSDLPRFQAARQALQLSSSSAWNSVQTAVINVFKGGGLQSNELYALNEN

SEQ ID NO: 67050 - protein, 63 aa, Homo sapiens
  Payload ID: 13375
  Gene Symbol: PRR5L
  Gene Name: proline rich 5 like
  ENSP ID: ENSP00000436485
MTRGFAPILPVEFHKMGSFRRPRPRFMSSPVLSDLPRFQAARQALQLSSSSAWNSVQTAVINV

SEQ ID NO: 67051 - protein, 274 aa, Homo sapiens
  Payload ID: 13376
  Gene Symbol: PRR7
  Gene Name: proline rich 7 (synaptic)
  Uniprot ID: Q8TB68
  ENSP ID: ENSP00000327168
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 67052 - protein, 274 aa, Homo sapiens; identical to SEQ ID NO: 67051
  Payload ID: 13376
  Gene Symbol: PRR7
  Gene Name: proline rich 7 (synaptic)
  Uniprot ID: Q8TB68
  ENSP ID: ENSP00000420872

SEQ ID NO: 67053 - protein, 274 aa, Homo sapiens; identical to SEQ ID NO: 67051
  Payload ID: 13376
  Gene Symbol: PRR7
  Gene Name: proline rich 7 (synaptic)
  Uniprot ID: Q8TB68
  ENSP ID: ENSP00000421039

SEQ ID NO: 67054 - protein, 178 aa, Homo sapiens
  Payload ID: 13376
  Gene Symbol: PRR7
  Gene Name: proline rich 7 (synaptic)
  ENSP ID: ENSP00000426601
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYR

SEQ ID NO: 67055 - protein, 116 aa, Homo sapiens
  Payload ID: 13377
  Gene Symbol: PRR9
  Gene Name: proline rich 9
  Uniprot ID: Q5T870
  ENSP ID: ENSP00000357733
MSFSEQQCKQPCVPPPCLPKTQEQCQAKAEEVCLPTCQHPCQDKCLVQAQEVCLSQCQESSQEKCPQQGQEPYLPPCQDQCPPQCAEPCQELFQTKCVEVCPQKVQEKCSSPGKGK

SEQ ID NO: 67056 - protein, 218 aa, Homo sapiens
  Payload ID: 13378
  Gene Symbol: PRRG1
  Gene Name: proline rich Gla (G-carboxyglutamic acid) 1
  Uniprot ID: O14668
  ENSP ID: ENSP00000367894
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 67057 - protein, 218 aa, Homo sapiens; identical to SEQ ID NO: 67056
  Payload ID: 13378
  Gene Symbol: PRRG1
  Gene Name: proline rich Gla (G-carboxyglutamic acid) 1
  Uniprot ID: O14668
  ENSP ID: ENSP00000390332

SEQ ID NO: 67058 - protein, 149 aa, Homo sapiens
  Payload ID: 13378
  Gene Symbol: PRRG1
  Gene Name: proline rich Gla (G-carboxyglutamic acid) 1
  ENSP ID: ENSP00000418384
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFL

SEQ ID NO: 67059 - protein, 82 aa, Homo sapiens
  Payload ID: 13378
  Gene Symbol: PRRG1
  Gene Name: proline rich Gla (G-carboxyglutamic acid) 1
  Uniprot ID: O14668
  ENSP ID: ENSP00000419999
MGRVFLTGEKANSILKRYPRANGFFEEIRQGNIERECKEEFCTFEEAREAFENNEKTGLVLLPRLECSCEHGSLQPQLPVPK

SEQ ID NO: 67060 - protein, 114 aa, Homo sapiens
  Payload ID: 13378
  Gene Symbol: PRRG1
  Gene Name: proline rich Gla (G-carboxyglutamic acid) 1
  ENSP ID: ENSP00000420353
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQT

SEQ ID NO: 67061 - protein, 218 aa, Homo sapiens; identical to SEQ ID NO: 67056
  Payload ID: 13378
  Gene Symbol: PRRG1
  Gene Name: proline rich Gla (G-carboxyglutamic acid) 1
  Uniprot ID: O14668
  ENSP ID: ENSP00000443271

SEQ ID NO: 67062 - protein, 218 aa, Homo sapiens; identical to SEQ ID NO: 67056
  Payload ID: 13378
  Gene Symbol: PRRG1
  Gene Name: proline rich Gla (G-carboxyglutamic acid) 1
  Uniprot ID: O14668
  ENSP ID: ENSP00000444278

SEQ ID NO: 67063 - protein, 202 aa, Homo sapiens
  Payload ID: 13379
  Gene Symbol: PRRG2
  Gene Name: proline rich Gla (G-carboxyglutamic acid) 2
  Uniprot ID: O14669
  ENSP ID: ENSP00000246794
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 67064 - protein, 98 aa, Homo sapiens
  Payload ID: 13379
  Gene Symbol: PRRG2
  Gene Name: proline rich Gla (G-carboxyglutamic acid) 2
  ENSP ID: ENSP00000469258
MRGHPSLLLLYMALTTCLDTSPSEETDQEVFLGPPEAQSFLSSHTRIPRANHWDLELLTPGNLERECLEERCSWEEAREYFEDNTLTERFWESYIYNG

SEQ ID NO: 67065 - protein, 96 aa, Homo sapiens
  Payload ID: 13379
  Gene Symbol: PRRG2
  Gene Name: proline rich Gla (G-carboxyglutamic acid) 2
  ENSP ID: ENSP00000470401
MRGHPSLLLLYMALTTCLDTSPSEETDQVLPLPGVQDPAPSSFRPRNLDSQPLLLPPGPHCFPSPYDSSPRDPPFFCPSCLWVQKSSWVPQRPRAS

SEQ ID NO: 67066 - protein, 231 aa, Homo sapiens
  Payload ID: 13380
  Gene Symbol: PRRG3
  Gene Name: proline rich Gla (G-carboxyglutamic acid) 3 (transmembrane)
  Uniprot ID: Q9BZD7
  ENSP ID: ENSP00000359378
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRYLASRAGHTLPRVMVYRGTVHSQGEPSGHREAANSPQVVLGPSRGGRTTVRLESTLYLPELSLSRLSSTTPPPSYEEVTAPQESSSEEASVSYSDPPPKYEEIVAANPGADK

SEQ ID NO: 67067 - protein, 102 aa, Homo sapiens
  Payload ID: 13380
  Gene Symbol: PRRG3
  Gene Name: proline rich Gla (G-carboxyglutamic acid) 3 (transmembrane)
  ENSP ID: ENSP00000359379
MAGLSRALSSVFLEAKDAHSVLKRFPRANEFLEELRQGTIERECMEEICSYEEVKEVFENKEKTACTTLGLVLGVGVASGIARTGPGNADQSEARKDTQPKA

SEQ ID NO: 67068 - protein, 91 aa, Homo sapiens
  Payload ID: 13380
  Gene Symbol: PRRG3
  Gene Name: proline rich Gla (G-carboxyglutamic acid) 3 (transmembrane)
  ENSP ID: ENSP00000394121
DPSQSSDAMYVVVPLLGVALLIVIALFIIWRCQLQKATRHHPSYAQNRRCFAVRLAAPSFASKYSNVGAFPFRLWAASLSLARIYLTNIPK

SEQ ID NO: 67069 - protein, 52 aa, Homo sapiens
  Payload ID: 13380
  Gene Symbol: PRRG3
  Gene Name: proline rich Gla (G-carboxyglutamic acid) 3 (transmembrane)
  ENSP ID: ENSP00000411509
MAVFLEAKDAHSVLKRFPRANEFLEELRQGTIERECMEEICSYEEVKEVFEN

SEQ ID NO: 67070 - protein, 231 aa, Homo sapiens; identical to SEQ ID NO: 67066
  Payload ID: 13380
  Gene Symbol: PRRG3
  Gene Name: proline rich Gla (G-carboxyglutamic acid) 3 (transmembrane)
  Uniprot ID: Q9BZD7
  ENSP ID: ENSP00000440217

SEQ ID NO: 67071 - protein, 226 aa, Homo sapiens
  Payload ID: 13381
  Gene Symbol: PRRG4
  Gene Name: proline rich Gla (G-carboxyglutamic acid) 4 (transmembrane)
  Uniprot ID: Q9BZD6
  ENSP ID: ENSP00000257836
MFTLLVLLSQLPTVTLGFPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 67072 - protein, 124 aa, Homo sapiens
  Payload ID: 13382
  Gene Symbol: PRIMA1
  Gene Name: proline rich membrane anchor 1
  Uniprot ID: Q86XR5
  ENSP ID: ENSP00000320948
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRNHAI

SEQ ID NO: 67073 - protein, 153 aa, Homo sapiens
  Payload ID: 13382
  Gene Symbol: PRIMA1
  Gene Name: proline rich membrane anchor 1
  Uniprot ID: Q86XR5
  ENSP ID: ENSP00000376848
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRKPLRKDENGTSVAEYPMSASQSNKGVDVNNAVV

SEQ ID NO: 67074 - protein, 153 aa, Homo sapiens; identical to SEQ ID NO: 67073
  Payload ID: 13382
  Gene Symbol: PRIMA1
  Gene Name: proline rich membrane anchor 1
  Uniprot ID: Q86XR5
  ENSP ID: ENSP00000376851

SEQ ID NO: 67075 - protein, 124 aa, Homo sapiens; identical to SEQ ID NO: 67072
  Payload ID: 13382
  Gene Symbol: PRIMA1
  Gene Name: proline rich membrane anchor 1
  Uniprot ID: Q86XR5
  ENSP ID: ENSP00000434370

SEQ ID NO: 67076 - protein, 153 aa, Homo sapiens; identical to SEQ ID NO: 67073
  Payload ID: 13382
  Gene Symbol: PRIMA1
  Gene Name: proline rich membrane anchor 1
  Uniprot ID: Q86XR5
  ENSP ID: ENSP00000479082

SEQ ID NO: 67077 - protein, 124 aa, Homo sapiens; identical to SEQ ID NO: 67072
  Payload ID: 13382
  Gene Symbol: PRIMA1
  Gene Name: proline rich membrane anchor 1
  Uniprot ID: Q86XR5
  ENSP ID: ENSP00000479855

SEQ ID NO: 67078 - protein, 124 aa, Homo sapiens; identical to SEQ ID NO: 67072
  Payload ID: 13382
  Gene Symbol: PRIMA1
  Gene Name: proline rich membrane anchor 1
  Uniprot ID: Q86XR5
  ENSP ID: ENSP00000486875

SEQ ID NO: 67079 - protein, 153 aa, Homo sapiens; identical to SEQ ID NO: 67073
  Payload ID: 13382
  Gene Symbol: PRIMA1
  Gene Name: proline rich membrane anchor 1
  Uniprot ID: Q86XR5
  ENSP ID: ENSP00000486953

SEQ ID NO: 67080 - protein, 248 aa, Homo sapiens
  Payload ID: 13383
  Gene Symbol: PROL1
  Gene Name: proline rich, lacrimal 1
  Uniprot ID: Q99935
  ENSP ID: ENSP00000382485
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 67081 - protein, 200 aa, Homo sapiens
  Payload ID: 13383
  Gene Symbol: PROL1
  Gene Name: proline rich, lacrimal 1
  ENSP ID: ENSP00000483568
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATQHFHKTHNDDQLLNSTYLFNTRACHLHISSNPRSIY

SEQ ID NO: 67082 - protein, 182 aa, Homo sapiens
  Payload ID: 13384
  Gene Symbol: PRORY
  Gene Name: proline rich, Y-linked
  Uniprot ID: Q9H606
  ENSP ID: ENSP00000372213
MMRRSPSGLKSPRVSQGRKPRDPESLLFLRCCLGSEPHNLSSLLSPEAGQEPLPKLLPQPLAGHAAWGIHGVPTSLLLAGECWGQGMAVPADPPPASPYRTSPRPPPGPLPRYRPQQHLLLPLGRLHALCPGCPLQQSLQFERGTLSAPRLWSWMKLETIILSKLSQGQKTKHRMFSLISES

SEQ ID NO: 67083 - protein, 275 aa, Homo sapiens
  Payload ID: 13385
  Gene Symbol: PROSC
  Gene Name: proline synthetase co-transcribed homolog (bacterial)
  Uniprot ID: O94903
  ENSP ID: ENSP00000333551
MWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEHINAKCPNLEFVGLMTIGSFGHDLSQGPNPDFQLLLSLREELCKKLNIPADQVELSMGMSADFQHAVEVGSTNVRIGSTIFGERDYSKKPTPDKCAADVKAPLEVAQEH

SEQ ID NO: 67084 - protein, 152 aa, Homo sapiens
  Payload ID: 13385
  Gene Symbol: PROSC
  Gene Name: proline synthetase co-transcribed homolog (bacterial)
  ENSP ID: ENSP00000427778
MWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEES

SEQ ID NO: 67085 - protein, 137 aa, Homo sapiens
  Payload ID: 13385
  Gene Symbol: PROSC
  Gene Name: proline synthetase co-transcribed homolog (bacterial)
  ENSP ID: ENSP00000427886
MVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEHINAKCPNLEFVGLMTIGSFGHD

SEQ ID NO: 67086 - protein, 74 aa, Homo sapiens
  Payload ID: 13385
  Gene Symbol: PROSC
  Gene Name: proline synthetase co-transcribed homolog (bacterial)
  ENSP ID: ENSP00000428005
MWRAGSMSAELGVGCALRAVNERVQQAVARRPRDLPAIQPRLVAVSKTKPADMVIEAYGHGQRTFGENYVRALS

SEQ ID NO: 67087 - protein, 128 aa, Homo sapiens
  Payload ID: 13385
  Gene Symbol: PROSC
  Gene Name: proline synthetase co-transcribed homolog (bacterial)
  ENSP ID: ENSP00000429425
ILSLCPEIKWHFIGHLQKQNVNKLMAVPNLFMLETVDSVKLADKVNSSWQRKGSPERLKVMVQINTSGEEIYLFSVSFLEGKHGLPPSETIAIVEHINAKCPNLEFVGLMTIGSFGHDLSQGPNPDFQ

SEQ ID NO: 67088 - protein, 1180 aa, Homo sapiens
  Payload ID: 13386
  Gene Symbol: PELP1
  Gene Name: proline, glutamate and leucine rich protein 1
  ENSP ID: ENSP00000301396
MLLPSLSPRVQPAFTQCARPQPPPHAPSPVGGRRGVFASSRHATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 67089 - protein, 906 aa, Homo sapiens
  Payload ID: 13386
  Gene Symbol: PELP1
  Gene Name: proline, glutamate and leucine rich protein 1
  ENSP ID: ENSP00000416231
MELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 67090 - protein, 148 aa, Homo sapiens
  Payload ID: 13386
  Gene Symbol: PELP1
  Gene Name: proline, glutamate and leucine rich protein 1
  ENSP ID: ENSP00000458985
  MOD_RES (1)..(1): Any amino acid
XAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQGKLASFFLS

SEQ ID NO: 67091 - protein, 1180 aa, Homo sapiens; identical to SEQ ID NO: 67088
  Payload ID: 13386
  Gene Symbol: PELP1
  Gene Name: proline, glutamate and leucine rich protein 1
  ENSP ID: ENSP00000460300

SEQ ID NO: 67092 - protein, 301 aa, Homo sapiens
  Payload ID: 13386
  Gene Symbol: PELP1
  Gene Name: proline, glutamate and leucine rich protein 1
  ENSP ID: ENSP00000460959
  MOD_RES (1)..(1): Any amino acid
XSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLASPVQNEGPGVEMLLSSEDGDAHVLLQLRQRFSGLARCLGLMLSSEFGAPVSVPVQEILDFICRTLSVSSKNISLHGDGPLRLLLLPSI

SEQ ID NO: 67093 - protein, 156 aa, Homo sapiens
  Payload ID: 13386
  Gene Symbol: PELP1
  Gene Name: proline, glutamate and leucine rich protein 1
  ENSP ID: ENSP00000461380
  MOD_RES (1)..(1): Any amino acid
XTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQYPCLHTLFSAR

SEQ ID NO: 67094 - protein, 99 aa, Homo sapiens
  Payload ID: 13386
  Gene Symbol: PELP1
  Gene Name: proline, glutamate and leucine rich protein 1
  ENSP ID: ENSP00000461419
MELAVAVLRDLLRYAAQLPALFRDISMNHLPGLLTSLLGLRPECEQSALEGMKACMTYFPRACGSLKGKLASFFLSRVDALSPQLQQLACECYSRLPSL

SEQ ID NO: 67095 - protein, 1130 aa, Homo sapiens
  Payload ID: 13386
  Gene Symbol: PELP1
  Gene Name: proline, glutamate and leucine rich protein 1
  Uniprot ID: Q8IZL8
  ENSP ID: ENSP00000461625
MAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 67096 - protein, 382 aa, Homo sapiens
  Payload ID: 13387
  Gene Symbol: PRELP
  Gene Name: proline/arginine-rich end leucine-rich repeat protein
  Uniprot ID: P51888
  ENSP ID: ENSP00000343924
MRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 67097 - protein, 82 aa, Homo sapiens
  Payload ID: 13388
  Gene Symbol: PHGR1
  Gene Name: proline/histidine/glycine-rich 1
  Uniprot ID: C9JFL3
  ENSP ID: ENSP00000410024
MDPGPKGHCHCGGHGHPPGHCGPPPGHGPGPCGPPPHHGPGPCGPPPGHGPGPCGPPPHHGPGPCGPPPGHGPGHPPPGPHH

SEQ ID NO: 67098 - protein, 333 aa, Homo sapiens
  Payload ID: 13389
  Gene Symbol: PSRC1
  Gene Name: proline/serine-rich coiled-coil 1
  Uniprot ID: Q6PGN9
  ENSP ID: ENSP00000358919
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 67099 - protein, 310 aa, Homo sapiens
  Payload ID: 13389
  Gene Symbol: PSRC1
  Gene Name: proline/serine-rich coiled-coil 1
  Uniprot ID: Q6PGN9
  ENSP ID: ENSP00000358920
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRACQPNATHQPECATWQRCPTSGFSVNSKRASKTKHCRTQSAGKWTQGSCFPATKSSCHGCHSQQSAAPQESGSPRTYQVKRSGQQARLQ

SEQ ID NO: 67100 - protein, 333 aa, Homo sapiens; identical to SEQ ID NO: 67098
  Payload ID: 13389
  Gene Symbol: PSRC1
  Gene Name: proline/serine-rich coiled-coil 1
  Uniprot ID: Q6PGN9
  ENSP ID: ENSP00000358923

SEQ ID NO: 67101 - protein, 333 aa, Homo sapiens; identical to SEQ ID NO: 67098
  Payload ID: 13389
  Gene Symbol: PSRC1
  Gene Name: proline/serine-rich coiled-coil 1
  Uniprot ID: Q6PGN9
  ENSP ID: ENSP00000358925

SEQ ID NO: 67102 - protein, 333 aa, Homo sapiens; identical to SEQ ID NO: 67098
  Payload ID: 13389
  Gene Symbol: PSRC1
  Gene Name: proline/serine-rich coiled-coil 1
  Uniprot ID: Q6PGN9
  ENSP ID: ENSP00000386323

SEQ ID NO: 67103 - protein, 231 aa, Homo sapiens
  Payload ID: 13389
  Gene Symbol: PSRC1
  Gene Name: proline/serine-rich coiled-coil 1
  ENSP ID: ENSP00000387791
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQ

SEQ ID NO: 67104 - protein, 205 aa, Homo sapiens
  Payload ID: 13389
  Gene Symbol: PSRC1
  Gene Name: proline/serine-rich coiled-coil 1
  ENSP ID: ENSP00000413186
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGP

SEQ ID NO: 67105 - protein, 363 aa, Homo sapiens
  Payload ID: 13389
  Gene Symbol: PSRC1
  Gene Name: proline/serine-rich coiled-coil 1
  Uniprot ID: Q6PGN9
  ENSP ID: ENSP00000474667
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRVSGSGEFVGLTLKFLHPSPPGPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 67106 - protein, 122 aa, Homo sapiens
  Payload ID: 13389
  Gene Symbol: PSRC1
  Gene Name: proline/serine-rich coiled-coil 1
  ENSP ID: ENSP00000474682
  MOD_RES (1)..(1): Any amino acid
XKGSVRALRATSGKRPSNMKRESPTCNLFPASKSPASSPLTRSTPPVRGRAGPSGRAAASEETRAAKLRGAAAKSSSQLPIPSAIPRPASRMPLTSRSVPPGRGALPPDSLSTRKGLPRPST

SEQ ID NO: 67107 - protein, 310 aa, Homo sapiens
  Payload ID: 13390
  Gene Symbol: PRAP1
  Gene Name: proline-rich acidic protein 1
  ENSP ID: ENSP00000357542
MQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 67108 - protein, 151 aa, Homo sapiens
  Payload ID: 13390
  Gene Symbol: PRAP1
  Gene Name: proline-rich acidic protein 1
  Uniprot ID: Q96NZ9
  ENSP ID: ENSP00000416126
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 67109 - protein, 142 aa, Homo sapiens
  Payload ID: 13390
  Gene Symbol: PRAP1
  Gene Name: proline-rich acidic protein 1
  Uniprot ID: Q96NZ9
  ENSP ID: ENSP00000486265
MRRLLLVTSLVVVLLWEAGAVPAPKVPIKMQVKHWPSEQDPEKAWGARVVEPPEKDDQLVVLFPVQKPKLLTTEEKPRGTKAWMETEDTLGHVLSPEPDHDSLYHPPPEEDQGEERPRLWVMPNHQVLLGPEEDQDHIYHPQ

SEQ ID NO: 67110 - protein, 1015 aa, Homo sapiens
  Payload ID: 13391
  Gene Symbol: PROB1
  Gene Name: proline-rich basic protein 1
  Uniprot ID: E7EW31
  ENSP ID: ENSP00000416033
MLTALAPPALPGIPRQLPTAPARRQDSSGSSGSYYTAPGSPEPPDVGPDAKGPANWPWVAPGRGAGAQPRLSVSAQNSRQRHGPGSGFPRGPGSGPRPPQPQLRTLPSGEMEVIFGVGPLFGCSGADDREAQQQFTEPAFISPLPPGPASPAAVPRQSQVPDGGSRWATYLELRPRGPSPAAPAQFECVEVALEEGAAPARPRTVPKRQIELRPRPQSPPRAAGAPRPRLLLRTGSLDESLGPLQAAAGFVQTALARKLSPEAPAPSSATFGSTGRSEPETRETARSTHVVLEKAKSRPLRVRDNSAPAKAPRPWPSLRERAIRRDKPAPGTEPLGPVSSSIFLQSEEKIQEARKTRFPREAPDRTVQRARSPPFECRIPSEVPSRAVRPRSPSPPRQTPNGAVRGPRCPSPQNLSPWDRTTRRVSSPLFPEASSEWENQNPAVEETVSRRSPSPPILSQWNQCVAGERSPSLEAPSLWEIPHSAVADAVEPRSSPSPPAFFPWEAPDRPIGTWGPSPQETWDPMGPGSSIAFTQEAQNGLTQEELAPPTPSAPGTPEPTEMQSPSTREISDLAFGGSQQSPEVAAPEPPGSHPVGTLDADKCPEVLGPGEAASGRPRMAIPRPRDVRKLVKTTYAPGFPAGAQGSGLPAPPADPCGEEGGESKTQEPPALGPPAPAHYTSVFIKDFLPVVPHPYEPPEPSFDTVARDASQPNGVLRRRAENSTAKPFKRTEIRLPGALALGRRPEVTSRVRARGPGGENRDVEAQRLVPDGDGRTSPLGGARSSSQRSPVGPAGVRSPRPGSPQMQASPSPGIAPKPKTPPTAPEPAAAVQAPLPREPLALAGRTAPAQPRAASAPPTDRSPQSPSQGARRQPGAAPLGKVLVDPESGRYYFVEAPRQPRLRVLFDPESGQYVEVLLPPSSPGPPHRVYTPLALGLGLYPPAYGPIPSLSLPPSPGPQALGSPQLPWVSEAGPLDGTYYLPVSGTPNPAPPLLLCAPPSSSGPTQPGKGSLFPL

SEQ ID NO: 67111 - protein, 445 aa, Homo sapiens
  Payload ID: 13392
  Gene Symbol: PRRC1
  Gene Name: proline-rich coiled-coil 1
  Uniprot ID: Q96M27
  ENSP ID: ENSP00000296666
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 67112 - protein, 418 aa, Homo sapiens
  Payload ID: 13392
  Gene Symbol: PRRC1
  Gene Name: proline-rich coiled-coil 1
  Uniprot ID: Q96M27
  ENSP ID: ENSP00000392873
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQVGFLLCFFIMLQRNLHYCFQNKNLFGFFVRNMFLILFQSFFF

SEQ ID NO: 67113 - protein, 462 aa, Homo sapiens
  Payload ID: 13392
  Gene Symbol: PRRC1
  Gene Name: proline-rich coiled-coil 1
  Uniprot ID: Q96M27
  ENSP ID: ENSP00000421965
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIADDYFPRIPKEQWQSMAWLKLEIFLPLVTW

SEQ ID NO: 67114 - protein, 2157 aa, Homo sapiens
  Payload ID: 13393
  Gene Symbol: PRRC2A
  Gene Name: proline-rich coiled-coil 2A
  Uniprot ID: P48634
  ENSP ID: ENSP00000365175
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGLALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 67115 - protein, 2157 aa, Homo sapiens; identical to SEQ ID NO: 67114
  Payload ID: 13393
  Gene Symbol: PRRC2A
  Gene Name: proline-rich coiled-coil 2A
  Uniprot ID: P48634
  ENSP ID: ENSP00000365201

SEQ ID NO: 67116 - protein, 2157 aa, Homo sapiens
  Payload ID: 13393
  Gene Symbol: PRRC2A
  Gene Name: proline-rich coiled-coil 2A
  Uniprot ID: P48634
  ENSP ID: ENSP00000372947
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPSLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 67117 - protein, 2157 aa, Homo sapiens; identical to SEQ ID NO: 67116
  Payload ID: 13393
  Gene Symbol: PRRC2A
  Gene Name: proline-rich coiled-coil 2A
  Uniprot ID: P48634
  ENSP ID: ENSP00000372956

SEQ ID NO: 67118 - protein, 2157 aa, Homo sapiens
  Payload ID: 13393
  Gene Symbol: PRRC2A
  Gene Name: proline-rich coiled-coil 2A
  Uniprot ID: P48634
  ENSP ID: ENSP00000387477
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 67119 - protein, 2157 aa, Homo sapiens; identical to SEQ ID NO: 67116
  Payload ID: 13393
  Gene Symbol: PRRC2A
  Gene Name: proline-rich coiled-coil 2A
  Uniprot ID: P48634
  ENSP ID: ENSP00000387910

SEQ ID NO: 67120 - protein, 2157 aa, Homo sapiens
  Payload ID: 13393
  Gene Symbol: PRRC2A
  Gene Name: proline-rich coiled-coil 2A
  Uniprot ID: P48634
  ENSP ID: ENSP00000396812
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 67121 - protein, 2157 aa, Homo sapiens
  Payload ID: 13393
  Gene Symbol: PRRC2A
  Gene Name: proline-rich coiled-coil 2A
  Uniprot ID: P48634
  ENSP ID: ENSP00000400540
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPLESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 67122 - protein, 2157 aa, Homo sapiens; identical to SEQ ID NO: 67120
  Payload ID: 13393
  Gene Symbol: PRRC2A
  Gene Name: proline-rich coiled-coil 2A
  Uniprot ID: P48634
  ENSP ID: ENSP00000404619

SEQ ID NO: 67123 - protein, 2157 aa, Homo sapiens; identical to SEQ ID NO: 67118
  Payload ID: 13393
  Gene Symbol: PRRC2A
  Gene Name: proline-rich coiled-coil 2A
  Uniprot ID: P48634
  ENSP ID: ENSP00000408226

SEQ ID NO: 67124 - protein, 2157 aa, Homo sapiens; identical to SEQ ID NO: 67116
  Payload ID: 13393
  Gene Symbol: PRRC2A
  Gene Name: proline-rich coiled-coil 2A
  Uniprot ID: P48634
  ENSP ID: ENSP00000409444

SEQ ID NO: 67125 - protein, 2157 aa, Homo sapiens; identical to SEQ ID NO: 67116
  Payload ID: 13393
  Gene Symbol: PRRC2A
  Gene Name: proline-rich coiled-coil 2A
  Uniprot ID: P48634
  ENSP ID: ENSP00000413977

SEQ ID NO: 67126 - protein, 2157 aa, Homo sapiens; identical to SEQ ID NO: 67121
  Payload ID: 13393
  Gene Symbol: PRRC2A
  Gene Name: proline-rich coiled-coil 2A
  Uniprot ID: P48634
  ENSP ID: ENSP00000415182

SEQ ID NO: 67127 - protein, 2157 aa, Homo sapiens; identical to SEQ ID NO: 67116
  Payload ID: 13393
  Gene Symbol: PRRC2A
  Gene Name: proline-rich coiled-coil 2A
  Uniprot ID: P48634
  ENSP ID: ENSP00000415363

SEQ ID NO: 67128 - protein, 178 aa, Homo sapiens
  Payload ID: 13394
  Gene Symbol: PRRC2B
  Gene Name: proline-rich coiled-coil 2B
  ENSP ID: ENSP00000326101
  MOD_RES (1)..(1): Any amino acid
XRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 67129 - protein, 2229 aa, Homo sapiens
  Payload ID: 13394
  Gene Symbol: PRRC2B
  Gene Name: proline-rich coiled-coil 2B
  Uniprot ID: Q5JSZ5
  ENSP ID: ENSP00000349856
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQEQLYKMQHWQPVYPPPSHPQRTFYPHHPQMLGFDPRWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNGSPNKQPSSEPEWTPEPRSSSSQHPEQTGRTRRSGPIKKPVLKALKVEDKEKELEKIKQELGEESTRLAKEKEQSPTAEKDEDEENDASLANSSTTTLEDKGPGHATFGREATKFEEEEKPDKAWEARPPRESSDVPPMKRNNWIFIDEEQAFGVRGQARGRGRGFREFTFRGRPAGGNGSGLCGGGVLGARSIYCSSQRSGRGRGLREFARPEDCPRAKPRRRVASETHSEGSEYEELPKRRRQRGSENGNEGSLLEREESTLKKGDCRDSWRSNKGCSEDHSGLDAKSRGPRAFGRALPPRLSNCGYGRRTFVSKESPHWQSKSPGSSWQEYGPSDTCGSRRPTDRDYVPDSYRHPDAFGGRGFEDSRAEDKRSFFQDEHVADSENAENRPFRRRRPPRQDKPPRFRRLRQERESLGLWGPEEEPHLLAGQWPGRPKLCSGDKSGTVGRRSPELSYQNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 67130 - protein, 1535 aa, Homo sapiens
  Payload ID: 13394
  Gene Symbol: PRRC2B
  Gene Name: proline-rich coiled-coil 2B
  Uniprot ID: Q5JSZ5
  ENSP ID: ENSP00000384606
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQEQLYKMQHWQPVYPPPSHPQRTFYPHHPQMLGFDPRWMMMPSYMDPRITPTRTPVDFYPSALHPSGLMKPMMPQESLNGTGCRSEDQNCVPPLQERKVTPIDSPPVWSPEGYMALQSKGYPLPHPKSSDTLAMDMRVRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEQGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLKMESARKAWENSPSLPEQSSPGGAGSGIQPPSSVGASSGVNYSSFGGVSMPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 67131 - protein, 588 aa, Homo sapiens
  Payload ID: 13394
  Gene Symbol: PRRC2B
  Gene Name: proline-rich coiled-coil 2B
  ENSP ID: ENSP00000388579
  MOD_RES (1)..(1): Any amino acid
XGRGFEDSRAEDKRSFFQDEHVADSENAENRPFRRRRPPRQDKPPRFRRLRQERESLGLWGPEEEPHLLAGQWPGRPKLCSGDKSGTVGRRSPELSYQNSSDHANEEWETASESSDFSERRERREGPGSEPDSQVDGGLSGASLGEKKELAKRSFSSQRPVVDRQSRKLEPGGFGEKPVRPGGGDTSPRYESQQNGTPLKVKRSPDEALPGGLSGCSSGSGHSPYALERAAHASADLPEASSKKAEKEAKLAAPRAGEQGEAMKQFDLNYGSAIIENCGSSPGEESEVGSMVGEGFIEVLTKKQRRLLEEERRKKEQAVQVPVKGRGLSSRIPPRFAKKQNNLCLEQGDVTVPGSSLGTEIWESSSQALPVQAPANDSWRKAVTAFSSTETGSAEGFKSSQGDSGVDLSAESRESSATSSQRSSPYGTLKPEEMSGPGLAEPKADSHKEQAPKPSEQKDSEQGSGQSKEHRPGPIGNERSLKNRKGSEGAERLQGAVVPPVNGVEIHVDSVLPVPPIEFGVSPKDSDFSLPPGSASGPTGSPVVKLQDALASNAGLTQSIPILRRDHHIQRAIGLSPMSFPTADLTLK

SEQ ID NO: 67132 - protein, 178 aa, Homo sapiens
  Payload ID: 13394
  Gene Symbol: PRRC2B
  Gene Name: proline-rich coiled-coil 2B
  ENSP ID: ENSP00000391063
CEGRQAKVKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQE

SEQ ID NO: 67133 - protein, 268 aa, Homo sapiens
  Payload ID: 13394
  Gene Symbol: PRRC2B
  Gene Name: proline-rich coiled-coil 2B
  Uniprot ID: Q5JSZ5
  ENSP ID: ENSP00000398853
MPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRQNNEWMRNPAWEP

SEQ ID NO: 67134 - protein, 175 aa, Homo sapiens
  Payload ID: 13394
  Gene Symbol: PRRC2B
  Gene Name: proline-rich coiled-coil 2B
  ENSP ID: ENSP00000400608
ERKVTPIDSPPVWSPEGYMALQSKGYPLPHPKSSDTLAMDMRVRNESSFSASLGRAGGVSAQRDLFEERGEEYLSAFDKKAQADFDSCISSQRIGQELLFPPQENVQDAGAPGGHTQNLRCSPLEPDFVPDEKKPECGSWDVSHQPETADTAHGVERETPREGTAFNISSWDKNG

SEQ ID NO: 67135 - protein, 2817 aa, Homo sapiens
  Payload ID: 13395
  Gene Symbol: PRRC2C
  Gene Name: proline-rich coiled-coil 2C
  Uniprot ID: Q9Y520
  ENSP ID: ENSP00000343629
MSEKSGQSTKAKDGKKYATLSLFNTYKGKSLETQKTTARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 67136 - protein, 2819 aa, Homo sapiens
  Payload ID: 13395
  Gene Symbol: PRRC2C
  Gene Name: proline-rich coiled-coil 2C
  ENSP ID: ENSP00000356716
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARKRREEEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSAPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 67137 - protein, 299 aa, Homo sapiens [sequence omitted]

SEQ ID NO: 67138 - protein, 2817 aa, Homo sapiens; identical to SEQ ID NO: 67135
  Payload ID: 13395
  Gene Symbol: PRRC2C
  Gene Name: proline-rich coiled-coil 2C
  Uniprot ID: Q9Y520
  ENSP ID: ENSP00000410219

SEQ ID NO: 67139 - protein, 1300 aa, Homo sapiens
  Payload ID: 13395
  Gene Symbol: PRRC2C
  Gene Name: proline-rich coiled-coil 2C
  ENSP ID: ENSP00000420382
  MOD_RES (1)..(1): Any amino acid
XAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDSTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 67140 - protein, 327 aa, Homo sapiens
  Payload ID: 13396
  Gene Symbol: PNRC1
  Gene Name: proline-rich nuclear receptor coactivator 1
  Uniprot ID: Q12796
  ENSP ID: ENSP00000336931
MTVVSVPQREPLVLGGRLAPLGFSSRGYFGALPMVTTAPPPLPRIPDPRALPPTLFLPHFLGGDGPCLTPQPRAPAALPNRSLAVAGGTPRAAPKKRRKKKVRASPAGQLPSRFHQYQQHRPSLEGGRSPATGPSGAQEVPGPAAALAPSPAAAAGTEGASPDLAPLRPAAPGQTPLRKEVLKSKMGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 67141 - protein, 142 aa, Homo sapiens
  Payload ID: 13396
  Gene Symbol: PNRC1
  Gene Name: proline-rich nuclear receptor coactivator 1
  ENSP ID: ENSP00000347000
MGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 67142 - protein, 142 aa, Homo sapiens; identical to SEQ ID NO: 67141
  Payload ID: 13396
  Gene Symbol: PNRC1
  Gene Name: proline-rich nuclear receptor coactivator 1
  ENSP ID: ENSP00000358484

SEQ ID NO: 67143 - protein, 139 aa, Homo sapiens
  Payload ID: 13397
  Gene Symbol: PNRC2
  Gene Name: proline-rich nuclear receptor coactivator 2
  Uniprot ID: Q9NPJ4
  ENSP ID: ENSP00000334840
MGGGERYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 67144 - protein, 139 aa, Homo sapiens; identical to SEQ ID NO: 67143
  Payload ID: 13397
  Gene Symbol: PNRC2
  Gene Name: proline-rich nuclear receptor coactivator 2
  Uniprot ID: Q9NPJ4
  ENSP ID: ENSP00000363592

SEQ ID NO: 67145 - protein, 56 aa, Homo sapiens
  Payload ID: 13397
  Gene Symbol: PNRC2
  Gene Name: proline-rich nuclear receptor coactivator 2
  ENSP ID: ENSP00000462379
MLASAPRLNSADRPMKTSVLRQRKGSVRKQHLLSWAWQQGRGQVVEILQSEKQTER

SEQ ID NO: 67146 - protein, 2 aa, Homo sapiens
  Payload ID: 13397
  Gene Symbol: PNRC2
  Gene Name: proline-rich nuclear receptor coactivator 2
  ENSP ID: ENSP00000464216
MG

SEQ ID NO: 67147 - protein, 198 aa, Homo sapiens
  Payload ID: 13398
  Gene Symbol: PRB1
  Gene Name: proline-rich protein BstNI subfamily 1
  ENSP ID: ENSP00000420826
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 67148 - protein, 330 aa, Homo sapiens
  Payload ID: 13398
  Gene Symbol: PRB1
  Gene Name: proline-rich protein BstNI subfamily 1
  ENSP ID: ENSP00000442127
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNRPQGPPPPGKPQGPPPQGDKSRSPSPPGKPQGPPPQGGNQPQGPPPPPGKPQGPPPQGGKKPQGPPPPGKPQGPPPQGDKSRSSQSPPGKPQGPPPQGGNQPQGPPPPPGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 67149 - protein, 178 aa, Homo sapiens
  Payload ID: 13398
  Gene Symbol: PRB1
  Gene Name: proline-rich protein BstNI subfamily 1
  ENSP ID: ENSP00000444249
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPAQGGSKSQSARSPPGKPQGPPQQEGNNPQGPPPPAGGNPQQPQAPPAGQPQGPPRPPQGGRPSRPPQ

SEQ ID NO: 67150 - protein, 416 aa, Homo sapiens
  Payload ID: 13398
  Gene Symbol: PRB1
  Gene Name: proline-rich protein BstNI subfamily 1
  ENSP ID: ENSP00000478365
MLLILLSVALLALSSAQNLNEDVSQEESPSLIAGNPQGAPPQGGNKPQGPPSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSRSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 67151 - protein, 330 aa, Homo sapiens; identical to SEQ ID NO: 67148
  Payload ID: 13398
  Gene Symbol: PRB1
  Gene Name: proline-rich protein BstNI subfamily 1
  ENSP ID: ENSP00000479599

SEQ ID NO: 67152 - protein, 333 aa, Homo sapiens
  Payload ID: 13398
  Gene Symbol: PRB1
  Gene Name: proline-rich protein BstNI subfamily 1
  ENSP ID: ENSP00000479646
MLLILLSVALLALSSAQNLNEDVSQEESPSLIAGKPQGPPPQGGNQPQGPPPPPGKPQGPPPQGGNKPQGPPPPGKPQGPPPQGDNKSRSARSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSARSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 67153 - protein, 178 aa, Homo sapiens
  Payload ID: 13398
  Gene Symbol: PRB1
  Gene Name: proline-rich protein BstNI subfamily 1
  ENSP ID: ENSP00000484902
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGKPQGPPPQGGSKSRSARSPPGKPQGPPQQEGNNPQGPPPPAGGNPQQPQAPPAGQPQGPPRPPQGGRPSRPPQ

SEQ ID NO: 67154 - protein, 151 aa, Homo sapiens
  Payload ID: 13398
  Gene Symbol: PRB1
  Gene Name: proline-rich protein BstNI subfamily 1
  ENSP ID: ENSP00000485971
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNRPQGPPPPGKPQGPPPQGDKSRSP

SEQ ID NO: 67155 - protein, 580 aa, Homo sapiens
  Payload ID: 13398
  Gene Symbol: PRB1
  Gene Name: proline-rich protein BstNI subfamily 1
  ENSP ID: ENSP00000486506
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSRSARSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSRSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 67156 - protein, 198 aa, Homo sapiens
  Payload ID: 13398
  Gene Symbol: PRB1
  Gene Name: proline-rich protein BstNI subfamily 1
  ENSP ID: ENSP00000486960
MLLILLSVALLALSSAQNLNEDVSQEESPSLIAGKPQGPPPQGGNQPQGPPPPPGKPQGPPPQGGNKPQGPPPPGKPQGPPPQGDKSRSPRSPPGKPQGPPPQGGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 67157 - protein, 178 aa, Homo sapiens; identical to SEQ ID NO: 67149
  Payload ID: 13398
  Gene Symbol: PRB1
  Gene Name: proline-rich protein BstNI subfamily 1
  ENSP ID: ENSP00000487691

SEQ ID NO: 67158 - protein, 198 aa, Homo sapiens; identical to SEQ ID NO: 67147
  Payload ID: 13398
  Gene Symbol: PRB1
  Gene Name: proline-rich protein BstNI subfamily 1
  ENSP ID: ENSP00000488239

SEQ ID NO: 67159 - protein, 416 aa, Homo sapiens
  Payload ID: 13399
  Gene Symbol: PRB2
  Gene Name: proline-rich protein BstNI subfamily 2
  Uniprot ID: P02812
  ENSP ID: ENSP00000374013
MLLILLSVALLALSSAQNLNEDVSQEESPSLIAGNPQGAPPQGGNKPQGPPSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 67160 - protein, 21 aa, Homo sapiens
  Payload ID: 13399
  Gene Symbol: PRB2
  Gene Name: proline-rich protein BstNI subfamily 2
  ENSP ID: ENSP00000456086
MLLILLSVALLALSSAQNLNE

SEQ ID NO: 67161 - protein, 309 aa, Homo sapiens
  Payload ID: 13400
  Gene Symbol: PRB3
  Gene Name: proline-rich protein BstNI subfamily 3
  Uniprot ID: Q04118
  ENSP ID: ENSP00000371264
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 67162 - protein, 351 aa, Homo sapiens
  Payload ID: 13400
  Gene Symbol: PRB3
  Gene Name: proline-rich protein BstNI subfamily 3
  ENSP ID: ENSP00000442626
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNKPQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 67163 - protein, 309 aa, Homo sapiens; identical to SEQ ID NO: 67161
  Payload ID: 13400
  Gene Symbol: PRB3
  Gene Name: proline-rich protein BstNI subfamily 3
  ENSP ID: ENSP00000481020

SEQ ID NO: 67164 - protein, 309 aa, Homo sapiens
  Payload ID: 13400
  Gene Symbol: PRB3
  Gene Name: proline-rich protein BstNI subfamily 3
  ENSP ID: ENSP00000483379
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 67165 - protein, 351 aa, Homo sapiens; identical to SEQ ID NO: 67162
  Payload ID: 13400
  Gene Symbol: PRB3
  Gene Name: proline-rich protein BstNI subfamily 3
  ENSP ID: ENSP00000488472

SEQ ID NO: 67166 - protein, 247 aa, Homo sapiens
  Payload ID: 13401
  Gene Symbol: PRB4
  Gene Name: proline-rich protein BstNI subfamily 4
  ENSP ID: ENSP00000279575
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 67167 - protein, 178 aa, Homo sapiens
  Payload ID: 13401
  Gene Symbol: PRB4
  Gene Name: proline-rich protein BstNI subfamily 4
  ENSP ID: ENSP00000412740
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGKPQGPPQQEGNKPQGPPPPGKPQGPPPAGGNPQQPQAPPAGKPQGPPPPPQGGRPPRPAQGQQPPQ

SEQ ID NO: 67168 - protein, 247 aa, Homo sapiens; identical to SEQ ID NO: 67166
  Payload ID: 13401
  Gene Symbol: PRB4
  Gene Name: proline-rich protein BstNI subfamily 4
  ENSP ID: ENSP00000442834

SEQ ID NO: 67169 - protein, 247 aa, Homo sapiens; identical to SEQ ID NO: 67166
  Payload ID: 13401
  Gene Symbol: PRB4
  Gene Name: proline-rich protein BstNI subfamily 4
  ENSP ID: ENSP00000479661

SEQ ID NO: 67170 - protein, 178 aa, Homo sapiens; identical to SEQ ID NO: 67167
  Payload ID: 13401
  Gene Symbol: PRB4
  Gene Name: proline-rich protein BstNI subfamily 4
  ENSP ID: ENSP00000481695

SEQ ID NO: 67171 - protein, 268 aa, Homo sapiens
  Payload ID: 13401
  Gene Symbol: PRB4
  Gene Name: proline-rich protein BstNI subfamily 4
  ENSP ID: ENSP00000483311
MLLILLSVALLALSSAQNLNEDVSQEESPSLIAGKPQGPPPQGGNQPQGPPPPPGKPQGPPPQGGNQPQGPPPPPGKPEGRRPQGGNQPQRPPPPPGKPQGPPPQGGNQSQGPPPPPGKPEGRPPQGGNQSQGPPPHPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 67172 - protein, 247 aa, Homo sapiens; identical to SEQ ID NO: 67166
  Payload ID: 13401
  Gene Symbol: PRB4
  Gene Name: proline-rich protein BstNI subfamily 4
  ENSP ID: ENSP00000487696

SEQ ID NO: 67173 - protein, 178 aa, Homo sapiens; identical to SEQ ID NO: 67167
  Payload ID: 13401
  Gene Symbol: PRB4
  Gene Name: proline-rich protein BstNI subfamily 4
  ENSP ID: ENSP00000487916

SEQ ID NO: 67174 - protein, 166 aa, Homo sapiens; identical to SEQ ID NO: 67025
  Payload ID: 13402
  Gene Symbol: PRH1
  Gene Name: proline-rich protein HaeIII subfamily 1
  ENSP ID: ENSP00000412436

SEQ ID NO: 67175 - protein, 187 aa, Homo sapiens
  Payload ID: 13402
  Gene Symbol: PRH1
  Gene Name: proline-rich protein HaeIII subfamily 1
  ENSP ID: ENSP00000479168
MLLILLSVALLAFSSAQDLNEDVSQEDVPLVISDGGDSEQFLDEERQGPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 67176 - protein, 166 aa, Homo sapiens; identical to SEQ ID NO: 67025
  Payload ID: 13402
  Gene Symbol: PRH1
  Gene Name: proline-rich protein HaeIII subfamily 1
  ENSP ID: ENSP00000479778

SEQ ID NO: 67177 - protein, 140 aa, Homo sapiens
  Payload ID: 13402
  Gene Symbol: PRH1
  Gene Name: proline-rich protein HaeIII subfamily 1
  ENSP ID: ENSP00000481761
GPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 67178 - protein, 175 aa, Homo sapiens
  Payload ID: 13402
  Gene Symbol: PRH1
  Gene Name: proline-rich protein HaeIII subfamily 1
  ENSP ID: ENSP00000482068
MLLILLSVALLAFSSAQDLNEDGGDSEQFLDEERQGPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 67179 - protein, 140 aa, Homo sapiens; identical to SEQ ID NO: 67177
  Payload ID: 13402
  Gene Symbol: PRH1
  Gene Name: proline-rich protein HaeIII subfamily 1
  ENSP ID: ENSP00000488708

SEQ ID NO: 67180 - protein, 175 aa, Homo sapiens; identical to SEQ ID NO: 67178
  Payload ID: 13402
  Gene Symbol: PRH1
  Gene Name: proline-rich protein HaeIII subfamily 1
  ENSP ID: ENSP00000488755

SEQ ID NO: 67181 - protein, 187 aa, Homo sapiens; identical to SEQ ID NO: 67175
  Payload ID: 13402
  Gene Symbol: PRH1
  Gene Name: proline-rich protein HaeIII subfamily 1
  ENSP ID: ENSP00000488797

SEQ ID NO: 67182 - protein, 166 aa, Homo sapiens
  Payload ID: 13403
  Gene Symbol: PRH2
  Gene Name: proline-rich protein HaeIII subfamily 2
  Uniprot ID: P02810
  ENSP ID: ENSP00000371271
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 67183 - protein, 166 aa, Homo sapiens; identical to SEQ ID NO: 67182
  Payload ID: 13403
  Gene Symbol: PRH2
  Gene Name: proline-rich protein HaeIII subfamily 2
  Uniprot ID: P02810
  ENSP ID: ENSP00000379682

SEQ ID NO: 67184 - protein, 166 aa, Homo sapiens; identical to SEQ ID NO: 67182
  Payload ID: 13403
  Gene Symbol: PRH2
  Gene Name: proline-rich protein HaeIII subfamily 2
  Uniprot ID: P02810
  ENSP ID: ENSP00000458690

SEQ ID NO: 67185 - protein, 166 aa, Homo sapiens; identical to SEQ ID NO: 67182
  Payload ID: 13403
  Gene Symbol: PRH2
  Gene Name: proline-rich protein HaeIII subfamily 2
  Uniprot ID: P02810
  ENSP ID: ENSP00000461041

SEQ ID NO: 67186 - protein, 166 aa, Homo sapiens; identical to SEQ ID NO: 67182
  Payload ID: 13403
  Gene Symbol: PRH2
  Gene Name: proline-rich protein HaeIII subfamily 2
  Uniprot ID: P02810
  ENSP ID: ENSP00000481810

SEQ ID NO: 67187 - protein, 166 aa, Homo sapiens; identical to SEQ ID NO: 67182
  Payload ID: 13403
  Gene Symbol: PRH2
  Gene Name: proline-rich protein HaeIII subfamily 2
  Uniprot ID: P02810
  ENSP ID: ENSP00000483458

SEQ ID NO: 67188 - protein, 306 aa, Homo sapiens
  Payload ID: 13404
  Gene Symbol: PRRT1
  Gene Name: proline-rich transmembrane protein 1
  Uniprot ID: Q99946
  ENSP ID: ENSP00000211413
MSSEKSGLPDSVPHTSPPPYNAPQPPAEPPAPPPQAAPSSHHHHHHHYHQSGTATLPRLGAGGLASSAATAQRGPSSSATLPRPPHHAPPGPAAGAPPPGCATLPRMPPDPYLQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 67189 - protein, 225 aa, Homo sapiens
  Payload ID: 13404
  Gene Symbol: PRRT1
  Gene Name: proline-rich transmembrane protein 1
  Uniprot ID: Q99946
  ENSP ID: ENSP00000364292
MPGTQTPAPAEDPHSGCRDPVPARPQACHPKSQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 67190 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000372799

SEQ ID NO: 67191 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000389058

SEQ ID NO: 67192 - protein, 62 aa, Homo sapiens
  Payload ID: 13404
  Gene Symbol: PRRT1
  Gene Name: proline-rich transmembrane protein 1
  ENSP ID: ENSP00000389727
MPGTQTPAPAEDPHSGCRDPVPARPQACHPKSQETRFEGPLPPPPPAAAAPPPPAPAQTAQA

SEQ ID NO: 67193 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000390214

SEQ ID NO: 67194 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000393852

SEQ ID NO: 67195 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000394808

SEQ ID NO: 67196 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000395695

SEQ ID NO: 67197 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000396077

SEQ ID NO: 67198 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000396426

SEQ ID NO: 67199 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000396427

SEQ ID NO: 67200 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000397896

SEQ ID NO: 67201 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000398252

SEQ ID NO: 67202 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000398756

SEQ ID NO: 67203 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000405389

SEQ ID NO: 67204 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000411183

SEQ ID NO: 67205 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000411544

SEQ ID NO: 67206 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000411596

SEQ ID NO: 67207 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000413784

SEQ ID NO: 67208 - protein, 306 aa, Homo sapiens; identical to SEQ ID NO: 67188
  Payload ID: 13404
  Gene Symbol: PRRT1
  Gene Name: proline-rich transmembrane protein 1
  Uniprot ID: Q99946
  ENSP ID: ENSP00000414711

SEQ ID NO: 67209 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000415611

SEQ ID NO: 67210 - protein, 225 aa, Homo sapiens; identical to SEQ ID NO: 67189
  Payload ID: 13404
  Gene Symbol: PRRT1
  Gene Name: proline-rich transmembrane protein 1
  Uniprot ID: Q99946
  ENSP ID: ENSP00000416064

SEQ ID NO: 67211 - protein, 62 aa, Homo sapiens; identical to SEQ ID NO: 67192
  Payload ID: 13404
  Gene Symbol: PRRT1
  Gene Name: proline-rich transmembrane protein 1
  ENSP ID: ENSP00000416602

SEQ ID NO: 67212 - protein, 299 aa, Homo sapiens
  Payload ID: 13405
  Gene Symbol: PRRT2
  Gene Name: proline-rich transmembrane protein 2
  Uniprot ID: Q7Z6L0
  ENSP ID: ENSP00000300797
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMVSPMGP

SEQ ID NO: 67213 - protein, 340 aa, Homo sapiens
  Payload ID: 13405
  Gene Symbol: PRRT2
  Gene Name: proline-rich transmembrane protein 2
  Uniprot ID: Q7Z6L0
  ENSP ID: ENSP00000351608
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 67214 - protein, 106 aa, Homo sapiens
  Payload ID: 13405
  Gene Symbol: PRRT2
  Gene Name: proline-rich transmembrane protein 2
  ENSP ID: ENSP00000454634
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQ

SEQ ID NO: 67215 - protein, 394 aa, Homo sapiens
  Payload ID: 13405
  Gene Symbol: PRRT2
  Gene Name: proline-rich transmembrane protein 2
  Uniprot ID: Q7Z6L0
  ENSP ID: ENSP00000456226
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGGEWGLGTGRGGMEGLARAALLTPAPALSCLSSLPLLCLSLSPPPPVCPSLSSPTVYK

SEQ ID NO: 67216 - protein, 340 aa, Homo sapiens; identical to SEQ ID NO: 67213
  Payload ID: 13405
  Gene Symbol: PRRT2
  Gene Name: proline-rich transmembrane protein 2
  Uniprot ID: Q7Z6L0
  ENSP ID: ENSP00000458291

SEQ ID NO: 67217 - protein, 981 aa, Homo sapiens
  Payload ID: 13406
  Gene Symbol: PRRT3
  Gene Name: proline-rich transmembrane protein 3
  Uniprot ID: Q5FWE3
  ENSP ID: ENSP00000295984
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPDEAEEWPGRPQSHPPAPPVQAPSTSRRGLIRVTTQRALGQPPPPEPTASSMASAPASSPPANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPGRVGRFSWAWWGVHFWLRLLELTWALALALAAVAAARPRPPTEHACWAKLMRLACPAPSGKSEVPERPNNCYAGPSNVGAGSLDISKSLIRNPAESGQLATPSSGAWGSAASLGRGPQGGPGLSRNGVGPAPSLSELDLRPPSPINLSRSIDAALFREHLVRDSVFQRCGLRGLASPPPGGALRPRRGSHPKAELDDAGSSLLRGRCRSLSDVRVRGPVPQHVVEAPDGAAAAASGSSLDSFSRGSLKISWNPWRHGLSSVDSLPLDELPSTVQLLPAPTPAPDSTAARQGDGQGEVQPRGKPGESRSASSDTIEL

SEQ ID NO: 67218 - protein, 981 aa, Homo sapiens; identical to SEQ ID NO: 67217
  Payload ID: 13406
  Gene Symbol: PRRT3
  Gene Name: proline-rich transmembrane protein 3
  Uniprot ID: Q5FWE3
  ENSP ID: ENSP00000392511

SEQ ID NO: 67219 - protein, 421 aa, Homo sapiens
  Payload ID: 13406
  Gene Symbol: PRRT3
  Gene Name: proline-rich transmembrane protein 3
  Uniprot ID: Q5FWE3
  ENSP ID: ENSP00000404512
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPGESMAGVWGEGVLCLVTENLCWGCMGAEGGE

SEQ ID NO: 67220 - protein, 899 aa, Homo sapiens
  Payload ID: 13407
  Gene Symbol: PRRT4
  Gene Name: proline-rich transmembrane protein 4
  Uniprot ID: C9JH25
  ENSP ID: ENSP00000415026
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAAAALGSAAHRPLRPLRLASRGLHAFLAAFLSGLLLALSCWGGRRRRAGAPLGGSGFKGATPLPQGRSPFAPRESWRRAARTAPVAGTFGLLSGALQGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 67221 - protein, 419 aa, Homo sapiens
  Payload ID: 13407
  Gene Symbol: PRRT4
  Gene Name: proline-rich transmembrane protein 4
  ENSP ID: ENSP00000417878
  MOD_RES (1)..(1): Any amino acid
XSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPILACRRAAGPSSSACPRATRLRCCREAGSLGPQTRSPWGAPSLAGTRSCCSCARWQGQAQTSYSRAEVAGASKARRPTRPRPRLPLPAAITPWTSARPPQSTCDAASRRPSAARPCLRLASSRALPSRTLCLGSDSTAPPRWGPGAGPVRDQGRPLAPLRPRSSPPLGLGPQAAASHLARSADSRGTARPCCCVPAPTGPRAALWSASSVPRGPQEAAPASRPQDPTRPCPHPLATPQSLLLSCRPRRPCCRSSSWTPADRSTS

SEQ ID NO: 67222 - protein, 205 aa, Homo sapiens
  Payload ID: 13407
  Gene Symbol: PRRT4
  Gene Name: proline-rich transmembrane protein 4
  ENSP ID: ENSP00000419221
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRA

SEQ ID NO: 67223 - protein, 479 aa, Homo sapiens
  Payload ID: 13407
  Gene Symbol: PRRT4
  Gene Name: proline-rich transmembrane protein 4
  ENSP ID: ENSP00000419282
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAA

SEQ ID NO: 67224 - protein, 429 aa, Homo sapiens
  Payload ID: 13407
  Gene Symbol: PRRT4
  Gene Name: proline-rich transmembrane protein 4
  Uniprot ID: C9JH25
  ENSP ID: ENSP00000419296
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGQ

SEQ ID NO: 67225 - protein, 208 aa, Homo sapiens
  Payload ID: 13407
  Gene Symbol: PRRT4
  Gene Name: proline-rich transmembrane protein 4
  ENSP ID: ENSP00000420155
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLA

SEQ ID NO: 67226 - protein, 899 aa, Homo sapiens; identical to SEQ ID NO: 67220
  Payload ID: 13407
  Gene Symbol: PRRT4
  Gene Name: proline-rich transmembrane protein 4
  Uniprot ID: C9JH25
  ENSP ID: ENSP00000445239

SEQ ID NO: 67227 - protein, 413 aa, Homo sapiens
  Payload ID: 13408
  Gene Symbol: PSTPIP1
  Gene Name: proline-serine-threonine phosphatase interacting protein 1
  ENSP ID: ENSP00000368914
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAETLTPTPERNEGVYTAIAVQEIQGNPASPAQEYRALYDYTAQNPDELDLSAGDILEVILEGEDGWWTVERNGQRGFVPGSYLEKL

SEQ ID NO: 67228 - protein, 397 aa, Homo sapiens
  Payload ID: 13408
  Gene Symbol: PSTPIP1
  Gene Name: proline-serine-threonine phosphatase interacting protein 1
  Uniprot ID: O43586
  ENSP ID: ENSP00000452743
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPGEVRLADSAASRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 67229 - protein, 416 aa, Homo sapiens
  Payload ID: 13408
  Gene Symbol: PSTPIP1
  Gene Name: proline-serine-threonine phosphatase interacting protein 1
  Uniprot ID: O43586
  ENSP ID: ENSP00000452746
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 67230 - protein, 133 aa, Homo sapiens
  Payload ID: 13408
  Gene Symbol: PSTPIP1
  Gene Name: proline-serine-threonine phosphatase interacting protein 1
  ENSP ID: ENSP00000452779
  MOD_RES (1)..(1): Any amino acid
XDAGRLQHRRRHRQFHPGQEHGHRAPRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 67231 - protein, 417 aa, Homo sapiens
  Payload ID: 13408
  Gene Symbol: PSTPIP1
  Gene Name: proline-serine-threonine phosphatase interacting protein 1
  ENSP ID: ENSP00000452986
MNDRCPRPGSSSLARGCLLSVADGAGREGGPGPALPGLGRCCWRLALHQASLWQESELCRGRRLRMMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPGEVRLADSAASSSGALPELLRSGGHPADQQPWHTAVLRHDKEVLWTAARKSQDHFVGSFCCVHRDPDPHPRAE

SEQ ID NO: 67232 - protein, 145 aa, Homo sapiens
  Payload ID: 13408
  Gene Symbol: PSTPIP1
  Gene Name: proline-serine-threonine phosphatase interacting protein 1
  ENSP ID: ENSP00000453218
MASCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDA

SEQ ID NO: 67233 - protein, 175 aa, Homo sapiens
  Payload ID: 13408
  Gene Symbol: PSTPIP1
  Gene Name: proline-serine-threonine phosphatase interacting protein 1
  ENSP ID: ENSP00000453268
MNDRCPRPGSSSLARGCLLSVADGAGREGGPGPALPGLGRCCWRLALHQASLWQESELCRGRRLRMMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRE

SEQ ID NO: 67234 - protein, 208 aa, Homo sapiens
  Payload ID: 13408
  Gene Symbol: PSTPIP1
  Gene Name: proline-serine-threonine phosphatase interacting protein 1
  ENSP ID: ENSP00000453372
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQSQNKARQCKDSATEAERVYRQSIAQLEKVRAEWEQEHRT

SEQ ID NO: 67235 - protein, 252 aa, Homo sapiens
  Payload ID: 13408
  Gene Symbol: PSTPIP1
  Gene Name: proline-serine-threonine phosphatase interacting protein 1
  ENSP ID: ENSP00000453382
AQAEERYGKELVQIARKAGGQTEINSLRASFDSLKQQMENVGSSHIQLALTLREELRSLEEFRERQKEQRKKGMAVPRQSDCMEVKSPSWEYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPP

SEQ ID NO: 67236 - protein, 136 aa, Homo sapiens
  Payload ID: 13408
  Gene Symbol: PSTPIP1
  Gene Name: proline-serine-threonine phosphatase interacting protein 1
  ENSP ID: ENSP00000453531
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKGSLPRPRPSAQNLVSPAV

SEQ ID NO: 67237 - protein, 38 aa, Homo sapiens
  Payload ID: 13408
  Gene Symbol: PSTPIP1
  Gene Name: proline-serine-threonine phosphatase interacting protein 1
  ENSP ID: ENSP00000454118
MMPQLQFKDAFWASQSAGITSVSHRARLAIEHFEDCSH

SEQ ID NO: 67238 - protein, 101 aa, Homo sapiens
  Payload ID: 13408
  Gene Symbol: PSTPIP1
  Gene Name: proline-serine-threonine phosphatase interacting protein 1
  ENSP ID: ENSP00000454127
MCKDMEELLRQRAQAEERYGKELVQIARKAGGQTEINSLRASFDSLKQQMENVGSSHIQLALTLREELRSLEEFRERQKEQRKKSQERCCASSQGHSVLLA

SEQ ID NO: 67239 - protein, 334 aa, Homo sapiens
  Payload ID: 13409
  Gene Symbol: PSTPIP2
  Gene Name: proline-serine-threonine phosphatase interacting protein 2
  Uniprot ID: Q9H939
  ENSP ID: ENSP00000387261
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEMYEQVRKSLEMCSIQRDIEYFVNQRKTGQIPPAPIMYENFYSSQKNAVPAGKATGPNLARRGPLPIPKSSPDDPNYSLVDDYSLLYQ

SEQ ID NO: 67240 - protein, 312 aa, Homo sapiens
  Payload ID: 13409
  Gene Symbol: PSTPIP2
  Gene Name: proline-serine-threonine phosphatase interacting protein 2
  Uniprot ID: Q9H939
  ENSP ID: ENSP00000468622
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEHPSCMRISTPPRRMQSQQERLQGLTWQGEDPSQFLKAHQMIPITLWLMTTVCSISKINETRAFSG

SEQ ID NO: 67241 - protein, 804 aa, Homo sapiens
  Payload ID: 13410
  Gene Symbol: P3H1
  Gene Name: prolyl 3-hydroxylase 1
  Uniprot ID: Q32P28
  ENSP ID: ENSP00000236040
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGESSWCCGDPFPERPWFAFLFPKSHCQWLRHERSTWDTSSNALSLWSHCLVLPGPAVNGIQVGKEVKTGSDAEFLVPSLGPTSAVLFQRVGPAGKEMSLGPLRNLPCPLGSSS

SEQ ID NO: 67242 - protein, 736 aa, Homo sapiens
  Payload ID: 13410
  Gene Symbol: P3H1
  Gene Name: prolyl 3-hydroxylase 1
  Uniprot ID: Q32P28
  ENSP ID: ENSP00000296388
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 67243 - protein, 207 aa, Homo sapiens
  Payload ID: 13410
  Gene Symbol: P3H1
  Gene Name: prolyl 3-hydroxylase 1
  ENSP ID: ENSP00000361604
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKDLETQPHMQEFRLGVRLYSEEQPQEAVPHLEAALQEYFVAYEECRALCEGPY

SEQ ID NO: 67244 - protein, 697 aa, Homo sapiens
  Payload ID: 13410
  Gene Symbol: P3H1
  Gene Name: prolyl 3-hydroxylase 1
  Uniprot ID: Q32P28
  ENSP ID: ENSP00000380245
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGQGAGR

SEQ ID NO: 67245 - protein, 222 aa, Homo sapiens
  Payload ID: 13410
  Gene Symbol: P3H1
  Gene Name: prolyl 3-hydroxylase 1
  ENSP ID: ENSP00000408056
  MOD_RES (1)..(1): Any amino acid
XTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKFHVAGEASQSWWKAKRSKSHLTWMAAGKERTSAAGARRQSSSAECPPVLQRDGEGAAHHGVLLPPGYAPLLFLLSSGVPHCHRRGPGREEG

SEQ ID NO: 67246 - protein, 708 aa, Homo sapiens
  Payload ID: 13411
  Gene Symbol: P3H2
  Gene Name: prolyl 3-hydroxylase 2
  Uniprot ID: Q8IVL5
  ENSP ID: ENSP00000316881
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 67247 - protein, 137 aa, Homo sapiens
  Payload ID: 13411
  Gene Symbol: P3H2
  Gene Name: prolyl 3-hydroxylase 2
  ENSP ID: ENSP00000391374
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYR

SEQ ID NO: 67248 - protein, 134 aa, Homo sapiens
  Payload ID: 13411
  Gene Symbol: P3H2
  Gene Name: prolyl 3-hydroxylase 2
  ENSP ID: ENSP00000394326
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFA

SEQ ID NO: 67249 - protein, 527 aa, Homo sapiens
  Payload ID: 13411
  Gene Symbol: P3H2
  Gene Name: prolyl 3-hydroxylase 2
  Uniprot ID: Q8IVL5
  ENSP ID: ENSP00000408947
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 67250 - protein, 736 aa, Homo sapiens
  Payload ID: 13412
  Gene Symbol: P3H3
  Gene Name: prolyl 3-hydroxylase 3
  Uniprot ID: Q8IVL6
  ENSP ID: ENSP00000478600
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 67251 - protein, 437 aa, Homo sapiens
  Payload ID: 13413
  Gene Symbol: P3H4
  Gene Name: prolyl 3-hydroxylase family member 4 (non-enzymatic)
  Uniprot ID: Q92791
  ENSP ID: ENSP00000347649
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 67252 - protein, 437 aa, Homo sapiens; identical to SEQ ID NO: 67251
  Payload ID: 13413
  Gene Symbol: P3H4
  Gene Name: prolyl 3-hydroxylase family member 4 (non-enzymatic)
  Uniprot ID: Q92791
  ENSP ID: ENSP00000377505

SEQ ID NO: 67253 - protein, 73 aa, Homo sapiens
  Payload ID: 13413
  Gene Symbol: P3H4
  Gene Name: prolyl 3-hydroxylase family member 4 (non-enzymatic)
  ENSP ID: ENSP00000435615
  MOD_RES (1)..(1): Any amino acid
XLRELLEFTHMYLQSDDEMELEETEPPLEPEDALSDAEFEGEGDYEEGMYADWWQEPDAKGDEAEAEPEPELA

SEQ ID NO: 67254 - protein, 85 aa, Homo sapiens
  Payload ID: 13413
  Gene Symbol: P3H4
  Gene Name: prolyl 3-hydroxylase family member 4 (non-enzymatic)
  ENSP ID: ENSP00000464968
MARVAWGLLWLLLGSAGAQYEKYSFRGFPPEDLMPLAAAYGHALEQYEGESWRESARYLEAALRLHRLLRDSEAFCHANCSGPAP

SEQ ID NO: 67255 - protein, 221 aa, Homo sapiens
  Payload ID: 13413
  Gene Symbol: P3H4
  Gene Name: prolyl 3-hydroxylase family member 4 (non-enzymatic)
  ENSP ID: ENSP00000468174
  MOD_RES (1)..(1): Any amino acid
XKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIAVNDVRQAARSAASYMLFDPKDSVMQQNLVYYRFHRARWGLEEEDFQPREEAMLYHNQTAELRELLEFTHMYLQSDDE

SEQ ID NO: 67256 - protein, 534 aa, Homo sapiens
  Payload ID: 13414
  Gene Symbol: P4HA1
  Gene Name: prolyl 4-hydroxylase, alpha polypeptide I
  Uniprot ID: P13674
  ENSP ID: ENSP00000263556
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 67257 - protein, 534 aa, Homo sapiens
  Payload ID: 13414
  Gene Symbol: P4HA1
  Gene Name: prolyl 4-hydroxylase, alpha polypeptide I
  Uniprot ID: P13674
  ENSP ID: ENSP00000307318
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 67258 - protein, 534 aa, Homo sapiens; identical to SEQ ID NO: 67256
  Payload ID: 13414
  Gene Symbol: P4HA1
  Gene Name: prolyl 4-hydroxylase, alpha polypeptide I
  Uniprot ID: P13674
  ENSP ID: ENSP00000362099

SEQ ID NO: 67259 - protein, 534 aa, Homo sapiens; identical to SEQ ID NO: 67257
  Payload ID: 13414
  Gene Symbol: P4HA1
  Gene Name: prolyl 4-hydroxylase, alpha polypeptide I
  Uniprot ID: P13674
  ENSP ID: ENSP00000378353

SEQ ID NO: 67260 - protein, 516 aa, Homo sapiens
  Payload ID: 13414
  Gene Symbol: P4HA1
  Gene Name: prolyl 4-hydroxylase, alpha polypeptide I
  Uniprot ID: P13674
  ENSP ID: ENSP00000414464
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 67261 - protein, 535 aa, Homo sapiens
  Payload ID: 13415
  Gene Symbol: P4HA2
  Gene Name: prolyl 4-hydroxylase, alpha polypeptide II
  Uniprot ID: O15460
  ENSP ID: ENSP00000166534
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 67262 - protein, 533 aa, Homo sapiens
  Payload ID: 13415
  Gene Symbol: P4HA2
  Gene Name: prolyl 4-hydroxylase, alpha polypeptide II
  Uniprot ID: O15460
  ENSP ID: ENSP00000353772
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 67263 - protein, 533 aa, Homo sapiens; identical to SEQ ID NO: 67262
  Payload ID: 13415
  Gene Symbol: P4HA2
  Gene Name: prolyl 4-hydroxylase, alpha polypeptide II
  Uniprot ID: O15460
  ENSP ID: ENSP00000368379

SEQ ID NO: 67264 - protein, 533 aa, Homo sapiens; identical to SEQ ID NO: 67262
  Payload ID: 13415
  Gene Symbol: P4HA2
  Gene Name: prolyl 4-hydroxylase, alpha polypeptide II
  Uniprot ID: O15460
  ENSP ID: ENSP00000368394

SEQ ID NO: 67265 - protein, 535 aa, Homo sapiens; identical to SEQ ID NO: 67261
  Payload ID: 13415
  Gene Symbol: P4HA2
  Gene Name: prolyl 4-hydroxylase, alpha polypeptide II
  Uniprot ID: O15460
  ENSP ID: ENSP00000368398

SEQ ID NO: 67266 - protein, 167 aa, Homo sapiens
  Payload ID: 13415
  Gene Symbol: P4HA2
  Gene Name: prolyl 4-hydroxylase, alpha polypeptide II
  ENSP ID: ENSP00000378593
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVD

SEQ ID NO: 67267 - protein, 535 aa, Homo sapiens; identical to SEQ ID NO: 67261
  Payload ID: 13415
  Gene Symbol: P4HA2
  Gene Name: prolyl 4-hydroxylase, alpha polypeptide II
  Uniprot ID: O15460
  ENSP ID: ENSP00000384999

SEQ ID NO: 67268 - protein, 204 aa, Homo sapiens
  Payload ID: 13415
  Gene Symbol: P4HA2
  Gene Name: prolyl 4-hydroxylase, alpha polypeptide II
  ENSP ID: ENSP00000389523
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 67269 - protein, 236 aa, Homo sapiens
  Payload ID: 13415
  Gene Symbol: P4HA2
  Gene Name: prolyl 4-hydroxylase, alpha polypeptide II
  ENSP ID: ENSP00000391257
MKRQLVTNSFLHHLLIGQKRPRNAPRTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 67270 - protein, 101 aa, Homo sapiens
  Payload ID: 13415
  Gene Symbol: P4HA2
  Gene Name: prolyl 4-hydroxylase, alpha polypeptide II
  ENSP ID: ENSP00000394953
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALE

SEQ ID NO: 67271 - protein, 50 aa, Homo sapiens
  Payload ID: 13415
  Gene Symbol: P4HA2
  Gene Name: prolyl 4-hydroxylase, alpha polypeptide II
  ENSP ID: ENSP00000395956
MKLWVSALLMAWFGVLSCVQAEFFTSIGHMTDLIYAEKELVQSLKEYILV

SEQ ID NO: 67272 - protein, 146 aa, Homo sapiens
  Payload ID: 13415
  Gene Symbol: P4HA2
  Gene Name: prolyl 4-hydroxylase, alpha polypeptide II
  ENSP ID: ENSP00000396495
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLD

SEQ ID NO: 67273 - protein, 114 aa, Homo sapiens
  Payload ID: 13415
  Gene Symbol: P4HA2
  Gene Name: prolyl 4-hydroxylase, alpha polypeptide II
  ENSP ID: ENSP00000403883
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIA

SEQ ID NO: 67274 - protein, 184 aa, Homo sapiens
  Payload ID: 13415
  Gene Symbol: P4HA2
  Gene Name: prolyl 4-hydroxylase, alpha polypeptide II
  ENSP ID: ENSP00000405406
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYH

SEQ ID NO: 67275 - protein, 153 aa, Homo sapiens
  Payload ID: 13415
  Gene Symbol: P4HA2
  Gene Name: prolyl 4-hydroxylase, alpha polypeptide II
  ENSP ID: ENSP00000413542
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRG

SEQ ID NO: 67276 - protein, 544 aa, Homo sapiens
  Payload ID: 13416
  Gene Symbol: P4HA3
  Gene Name: prolyl 4-hydroxylase, alpha polypeptide III
  Uniprot ID: Q7Z4N8
  ENSP ID: ENSP00000332170
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 67277 - protein, 604 aa, Homo sapiens
  Payload ID: 13416
  Gene Symbol: P4HA3
  Gene Name: prolyl 4-hydroxylase, alpha polypeptide III
  Uniprot ID: Q7Z4N8
  ENSP ID: ENSP00000401749
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRHCFGGTCTGVVKGTVTHFMLAVLSWWEISGWPTSGYMSMDRNSADPAAPALKTELLAERSWWSPVAFQRSQEPKAGVGEEKAEQPPGRRPCQLCLCLANQRQGRGCYQGTLRMYI

SEQ ID NO: 67278 - protein, 104 aa, Homo sapiens
  Payload ID: 13416
  Gene Symbol: P4HA3
  Gene Name: prolyl 4-hydroxylase, alpha polypeptide III
  ENSP ID: ENSP00000431227
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVL

SEQ ID NO: 67279 - protein, 61 aa, Homo sapiens
  Payload ID: 13416
  Gene Symbol: P4HA3
  Gene Name: prolyl 4-hydroxylase, alpha polypeptide III
  ENSP ID: ENSP00000431350
SVPVVRNAALFWWNLHRSGEGDSDTLHAGCPVLVGDKWVANKWIHEYGQEFRRPCSSSPED

SEQ ID NO: 67280 - protein, 257 aa, Homo sapiens
  Payload ID: 13416
  Gene Symbol: P4HA3
  Gene Name: prolyl 4-hydroxylase, alpha polypeptide III
  Uniprot ID: Q7Z4N8
  ENSP ID: ENSP00000433860
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYR

SEQ ID NO: 67281 - protein, 508 aa, Homo sapiens
  Payload ID: 13417
  Gene Symbol: P4HB
  Gene Name: prolyl 4-hydroxylase, beta polypeptide
  Uniprot ID: P07237
  ENSP ID: ENSP00000327801
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 67282 - protein, 274 aa, Homo sapiens
  Payload ID: 13417
  Gene Symbol: P4HB
  Gene Name: prolyl 4-hydroxylase, beta polypeptide
  ENSP ID: ENSP00000388117
  MOD_RES (1)..(1): Any amino acid
XFEGEVTKENLLDFIKHNQLPLVIEFTEQSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 67283 - protein, 464 aa, Homo sapiens
  Payload ID: 13417
  Gene Symbol: P4HB
  Gene Name: prolyl 4-hydroxylase, beta polypeptide
  ENSP ID: ENSP00000388374
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 67284 - protein, 148 aa, Homo sapiens
  Payload ID: 13417
  Gene Symbol: P4HB
  Gene Name: prolyl 4-hydroxylase, beta polypeptide
  ENSP ID: ENSP00000458300
MLRRALLCLAVAALVRADAPEEEDHVLVLRKSNFAEALAAHKYLLVEFYAPWCGHCKALAPEYAKAAGKLKAEGSEIRLAKMDSTANEVEAVKVHSFPTLKFFPASADRTVIDYNGERTLDGFKKFLESGGQDGAGDDDDLEDLEEAE

SEQ ID NO: 67285 - protein, 54 aa, Homo sapiens
  Payload ID: 13417
  Gene Symbol: P4HB
  Gene Name: prolyl 4-hydroxylase, beta polypeptide
  ENSP ID: ENSP00000459211
MLRRALLCLAVAALVRADAPEEEDHVLVLRKSNFAEALAAHKCPLVWPLQGSGP

SEQ ID NO: 67286 - protein, 208 aa, Homo sapiens
  Payload ID: 13417
  Gene Symbol: P4HB
  Gene Name: prolyl 4-hydroxylase, beta polypeptide
  ENSP ID: ENSP00000460088
MLRRALLCLAVAALVRADAPEEEDHVLVLRKSNFAEALAAHKYLLVEFSGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKT

SEQ ID NO: 67287 - protein, 200 aa, Homo sapiens
  Payload ID: 13417
  Gene Symbol: P4HB
  Gene Name: prolyl 4-hydroxylase, beta polypeptide
  ENSP ID: ENSP00000460285
METRLPPRNIQDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKI

SEQ ID NO: 67288 - protein, 156 aa, Homo sapiens
  Payload ID: 13417
  Gene Symbol: P4HB
  Gene Name: prolyl 4-hydroxylase, beta polypeptide
  ENSP ID: ENSP00000460612
MLRRALLCLAVAALVRADAPEEEDHVLVLRKSNFAEALAAHKYLLVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDV

SEQ ID NO: 67289 - protein, 188 aa, Homo sapiens
  Payload ID: 13417
  Gene Symbol: P4HB
  Gene Name: prolyl 4-hydroxylase, beta polypeptide
  ENSP ID: ENSP00000460741
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAAESLVESSEVAVIGFFKDVESDSAKQFLQAAEAIDDIPFGITSNSDVFSKYQLDKDGVVLFKKFDEGRNN

SEQ ID NO: 67290 - protein, 117 aa, Homo sapiens
  Payload ID: 13417
  Gene Symbol: P4HB
  Gene Name: prolyl 4-hydroxylase, beta polypeptide
  ENSP ID: ENSP00000461362
METRLPPRNIQFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPA

SEQ ID NO: 67291 - protein, 106 aa, Homo sapiens
  Payload ID: 13417
  Gene Symbol: P4HB
  Gene Name: prolyl 4-hydroxylase, beta polypeptide
  ENSP ID: ENSP00000461718
MLRRALLCLAVAALVRADAPEEEDHVLVLRKSNFAEALAAHKYLLVEFYAPWCGHCKALAPEYAKAAGKLKAEGSEIRPPRRSLSPVWEGRSRTGHGHSVPPAVSP

SEQ ID NO: 67292 - protein, 166 aa, Homo sapiens
  Payload ID: 13417
  Gene Symbol: P4HB
  Gene Name: prolyl 4-hydroxylase, beta polypeptide
  ENSP ID: ENSP00000461791
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGFDEGRNNFEGEVTKENLLDFIKHNQLPLVIEFTEQTAPKIFGGEIKTH

SEQ ID NO: 67293 - protein, 563 aa, Homo sapiens
  Payload ID: 13418
  Gene Symbol: P4HTM
  Gene Name: prolyl 4-hydroxylase, transmembrane (endoplasmic reticulum)
  Uniprot ID: Q9NXG6
  ENSP ID: ENSP00000341422
MAAAAVTGQRPETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRQVSPNWGLPSILRPGTPMTQAQPCTVGVPLGMGPGDHWVIPVSPWEHPQLGTCSVPPLPYSYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 67294 - protein, 502 aa, Homo sapiens [sequence omitted]

SEQ ID NO: 67295 - protein, 226 aa, Homo sapiens
  Payload ID: 13418
  Gene Symbol: P4HTM
  Gene Name: prolyl 4-hydroxylase, transmembrane (endoplasmic reticulum)
  ENSP ID: ENSP00000398554
  MOD_RES (1)..(1): Any amino acid
XCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVLAQTRLGNGWWMTPESIQEMYAAIKADPDGDGVLSLQEFSNMDLRDFHKYMRSHKAESSELVRNSHHTWLYQGEGAHHIMRAIRQR

SEQ ID NO: 67296 - protein, 157 aa, Homo sapiens
  Payload ID: 13418
  Gene Symbol: P4HTM
  Gene Name: prolyl 4-hydroxylase, transmembrane (endoplasmic reticulum)
  ENSP ID: ENSP00000476303
  MOD_RES (1)..(1): Any amino acid
XIIHLAQMKGLQRSQILPTEEYEEAMSTMQVSQLDLFRLLDQNRDGHLQLREVLAQTRLGNGWWMTPESIQEMYAAIKADPDGDGWVGDVDDYSLHGGCLVTRGTKWIANNWINVDPSRARQALFQQEMARLAREGGTDSQPEWALDRAYRDARVEL

SEQ ID NO: 67297 - protein, 88 aa, Homo sapiens
  Payload ID: 13418
  Gene Symbol: P4HTM
  Gene Name: prolyl 4-hydroxylase, transmembrane (endoplasmic reticulum)
  ENSP ID: ENSP00000476858
EVLAQTRLGNGWWMTPESIQEMYAAIKADPDGDGVLSLQEFSNMDLRDFHKYMRSHKAESSELVRNSHHTWLYQGEGAHHIMRAIRQR

SEQ ID NO: 67298 - protein, 139 aa, Homo sapiens
  Payload ID: 13418
  Gene Symbol: P4HTM
  Gene Name: prolyl 4-hydroxylase, transmembrane (endoplasmic reticulum)
  ENSP ID: ENSP00000477191
DHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFASPVSPAATAPAPSLPSVPWP

SEQ ID NO: 67299 - protein, 710 aa, Homo sapiens
  Payload ID: 13419
  Gene Symbol: PREP
  Gene Name: prolyl endopeptidase
  Uniprot ID: P48147
  ENSP ID: ENSP00000358106
MLSLQYPDVYRDETAVQDYHGHKICDPYAWLEDPDSEQTKAFVEAQNKITVPFLEQCPIRGLYKERMTELYDYPKYSCHFKKGKRYFYFYNTGLQNQRVLYVQDSLEGEARVFLDPNILSDDGTVALRGYAFSEDGEYFAYGLSASGSDWVTIKFMKVDGAKELPDVLERVKFSCMAWTHDGKGMFYNSYPQQDGKSDGTETSTNLHQKLYYHVLGTDQSEDILCAEFPDEPKWMGGAELSDDGRYVLLSIREGCDPVNRLWYCDLQQESSGIAGILKWVKLIDNFEGEYDYVTNEGTVFTFKTNRQSPNYRVINIDFRDPEESKWKVLVPEHEKDVLEWIACVRSNFLVLCYLHDVKNILQLHDLTTGALLKTFPLDVGSIVGYSGQKKDTEIFYQFTSFLSPGIIYHCDLTKEELEPRVFREVTVKGIDASDYQTVQIFYPSKDGTKIPMFIVHKKGIKLDGSHPAFLYGYGGFNISITPNYSVSRLIFVRHMGGILAVANIRGGGEYGETWHKGGILANKQNCFDDFQCAAEYLIKEGYTSPKRLTINGGSNGGLLVAACANQRPDLFGCVIAQVGVMDMLKFHKYTIGHAWTTDYGCSDSKQHFEWLVKYSPLHNVKLPEADDIQYPSMLLLTADHDDRVVPLHSLKFIATLQYIVGRSRKQSNPLLIHVDTKAGHGAGKPTAKVIEEVSDMFAFIARCLNVDWIP

SEQ ID NO: 67300 - protein, 45 aa, Homo sapiens
  Payload ID: 13419
  Gene Symbol: PREP
  Gene Name: prolyl endopeptidase
  ENSP ID: ENSP00000401796
  MOD_RES (1)..(1): Any amino acid
XIIYHCDLTKEELEPRVFREVTVKGIDASDYQTVQLPKGTESSRN

SEQ ID NO: 67301 - protein, 727 aa, Homo sapiens
  Payload ID: 13420
  Gene Symbol: PREPL
  Gene Name: prolyl endopeptidase-like
  Uniprot ID: Q4J6C6
  ENSP ID: ENSP00000260648
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 67302 - protein, 665 aa, Homo sapiens
  Payload ID: 13420
  Gene Symbol: PREPL
  Gene Name: prolyl endopeptidase-like
  Uniprot ID: Q4J6C6
  ENSP ID: ENSP00000367772
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 67303 - protein, 661 aa, Homo sapiens
  Payload ID: 13420
  Gene Symbol: PREPL
  Gene Name: prolyl endopeptidase-like
  Uniprot ID: Q4J6C6
  ENSP ID: ENSP00000367781
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 67304 - protein, 727 aa, Homo sapiens; identical to SEQ ID NO: 67301
  Payload ID: 13420
  Gene Symbol: PREPL
  Gene Name: prolyl endopeptidase-like
  Uniprot ID: Q4J6C6
  ENSP ID: ENSP00000386509

SEQ ID NO: 67305 - protein, 727 aa, Homo sapiens; identical to SEQ ID NO: 67301
  Payload ID: 13420
  Gene Symbol: PREPL
  Gene Name: prolyl endopeptidase-like
  Uniprot ID: Q4J6C6
  ENSP ID: ENSP00000386543

SEQ ID NO: 67306 - protein, 727 aa, Homo sapiens; identical to SEQ ID NO: 67301
  Payload ID: 13420
  Gene Symbol: PREPL
  Gene Name: prolyl endopeptidase-like
  Uniprot ID: Q4J6C6
  ENSP ID: ENSP00000386909

SEQ ID NO: 67307 - protein, 638 aa, Homo sapiens
  Payload ID: 13420
  Gene Symbol: PREPL
  Gene Name: prolyl endopeptidase-like
  Uniprot ID: Q4J6C6
  ENSP ID: ENSP00000387095
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 67308 - protein, 638 aa, Homo sapiens; identical to SEQ ID NO: 67307
  Payload ID: 13420
  Gene Symbol: PREPL
  Gene Name: prolyl endopeptidase-like
  Uniprot ID: Q4J6C6
  ENSP ID: ENSP00000387241

SEQ ID NO: 67309 - protein, 70 aa, Homo sapiens
  Payload ID: 13420
  Gene Symbol: PREPL
  Gene Name: prolyl endopeptidase-like
  ENSP ID: ENSP00000390618
EWGNPSSDEKHKNYIKRYCPYQNIKPQHYPSIHITAYENDERVPLKGIVSYTEKLKEAIAEHAKDTGEGA

SEQ ID NO: 67310 - protein, 727 aa, Homo sapiens; identical to SEQ ID NO: 67301
  Payload ID: 13420
  Gene Symbol: PREPL
  Gene Name: prolyl endopeptidase-like
  Uniprot ID: Q4J6C6
  ENSP ID: ENSP00000391456

SEQ ID NO: 67311 - protein, 151 aa, Homo sapiens
  Payload ID: 13420
  Gene Symbol: PREPL
  Gene Name: prolyl endopeptidase-like
  ENSP ID: ENSP00000395034
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEEL

SEQ ID NO: 67312 - protein, 120 aa, Homo sapiens
  Payload ID: 13420
  Gene Symbol: PREPL
  Gene Name: prolyl endopeptidase-like
  ENSP ID: ENSP00000395692
  MOD_RES (1)..(1): Any amino acid
XIKRYCPYQNIKPQHYPSIHITAYENDERVPLKGIVSYTEKLKEAIAEHAKDTGEGYQTPNIILDIQPGGNHVIEDSHKKVCYQGPLSGQIPELDTCCFHIFSGCSRFMTKPLHKCPIYG

SEQ ID NO: 67313 - protein, 727 aa, Homo sapiens; identical to SEQ ID NO: 67301
  Payload ID: 13420
  Gene Symbol: PREPL
  Gene Name: prolyl endopeptidase-like
  Uniprot ID: Q4J6C6
  ENSP ID: ENSP00000409480

SEQ ID NO: 67314 - protein, 638 aa, Homo sapiens; identical to SEQ ID NO: 67307
  Payload ID: 13420
  Gene Symbol: PREPL
  Gene Name: prolyl endopeptidase-like
  Uniprot ID: Q4J6C6
  ENSP ID: ENSP00000439626

SEQ ID NO: 67315 - protein, 496 aa, Homo sapiens
  Payload ID: 13421
  Gene Symbol: PRCP
  Gene Name: prolylcarboxypeptidase (angiotensinase C)
  Uniprot ID: P42785
  ENSP ID: ENSP00000317362
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 67316 - protein, 517 aa, Homo sapiens
  Payload ID: 13421
  Gene Symbol: PRCP
  Gene Name: prolylcarboxypeptidase (angiotensinase C)
  Uniprot ID: P42785
  ENSP ID: ENSP00000377055
MGRRALLLLLLSFLAPWATIALRPALRALGSLHLPTNPTSLPAVAKNYSVLYFQQKALAAGQLHICIIQLNHYKTPLVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 67317 - protein, 147 aa, Homo sapiens
  Payload ID: 13421
  Gene Symbol: PRCP
  Gene Name: prolylcarboxypeptidase (angiotensinase C)
  ENSP ID: ENSP00000431435
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGS

SEQ ID NO: 67318 - protein, 43 aa, Homo sapiens
  Payload ID: 13421
  Gene Symbol: PRCP
  Gene Name: prolylcarboxypeptidase (angiotensinase C)
  ENSP ID: ENSP00000431496
MWDVAEELKAMLVFAEHRYYGESLPFGDNSFKDSRHLNFLTSE

SEQ ID NO: 67319 - protein, 192 aa, Homo sapiens
  Payload ID: 13421
  Gene Symbol: PRCP
  Gene Name: prolylcarboxypeptidase (angiotensinase C)
  ENSP ID: ENSP00000431559
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNF

SEQ ID NO: 67320 - protein, 233 aa, Homo sapiens
  Payload ID: 13421
  Gene Symbol: PRCP
  Gene Name: prolylcarboxypeptidase (angiotensinase C)
  ENSP ID: ENSP00000432004
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYS

SEQ ID NO: 67321 - protein, 145 aa, Homo sapiens
  Payload ID: 13421
  Gene Symbol: PRCP
  Gene Name: prolylcarboxypeptidase (angiotensinase C)
  ENSP ID: ENSP00000432506
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNT

SEQ ID NO: 67322 - protein, 163 aa, Homo sapiens
  Payload ID: 13421
  Gene Symbol: PRCP
  Gene Name: prolylcarboxypeptidase (angiotensinase C)
  ENSP ID: ENSP00000434771
MELRWPGQGLVVMIMVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASA

SEQ ID NO: 67323 - protein, 99 aa, Homo sapiens
  Payload ID: 13421
  Gene Symbol: PRCP
  Gene Name: prolylcarboxypeptidase (angiotensinase C)
  ENSP ID: ENSP00000435071
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASA

SEQ ID NO: 67324 - protein, 26 aa, Homo sapiens
  Payload ID: 13421
  Gene Symbol: PRCP
  Gene Name: prolylcarboxypeptidase (angiotensinase C)
  ENSP ID: ENSP00000436095
MWDVAEELKAMLVFAEHRYYGESLPF

SEQ ID NO: 67325 - protein, 183 aa, Homo sapiens
  Payload ID: 13421
  Gene Symbol: PRCP
  Gene Name: prolylcarboxypeptidase (angiotensinase C)
  ENSP ID: ENSP00000436141
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAM

SEQ ID NO: 67326 - protein, 116 aa, Homo sapiens
  Payload ID: 13421
  Gene Symbol: PRCP
  Gene Name: prolylcarboxypeptidase (angiotensinase C)
  ENSP ID: ENSP00000437169
MKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAEN

SEQ ID NO: 67327 - protein, 475 aa, Homo sapiens
  Payload ID: 13422
  Gene Symbol: PARS2
  Gene Name: prolyl-tRNA synthetase 2, mitochondrial (putative)
  Uniprot ID: Q7L3T8
  ENSP ID: ENSP00000360327
MEGLLTRCRALPALATCSRQLSGYVPCRFHHCAPRRGRRLLLSRVFQPQNLREDRVLSLQDKSDDLTCKSQRLMLQVGLIYPASPGCYHLLPYTVRAMEKLVRVIDQEMQAIGGQKVNMPSLSPAELWQATNRWDLMGKELLRLRDRHGKEYCLGPTHEEAITALIASQKKLSYKQLPFLLYQVTRKFRDEPRPRFGLLRGREFYMKDMYTFDSSPEAAQQTYSLVCDAYCSLFNKLGLPFVKVQADVGTIGGTVSHEFQLPVDIGEDRLAICPRCSFSANMETLDLSQMNCPACQGPLTKTKGIEVGHTFYLGTKYSSIFNAQFTNVCGKPTLAEMGCYGLGVTRILAAAIEVLSTEDCVRWPSLLAPYQACLIPPKKGSKEQAASELIGQLYDHITEAVPQLHGEVLLDDRTHLTIGNRLKDANKFGYPFVIIAGKRALEDPAHFEVWCQNTGEVAFLTKDGVMDLLTPVQTV

SEQ ID NO: 67328 - protein, 165 aa, Homo sapiens
  Payload ID: 13423
  Gene Symbol: PMCH
  Gene Name: pro-melanin-concentrating hormone
  Uniprot ID: P20382
  ENSP ID: ENSP00000332225
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 67329 - protein, 865 aa, Homo sapiens
  Payload ID: 13424
  Gene Symbol: PROM1
  Gene Name: prominin 1
  Uniprot ID: O43490
  ENSP ID: ENSP00000415481
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 67330 - protein, 40 aa, Homo sapiens
  Payload ID: 13424
  Gene Symbol: PROM1
  Gene Name: prominin 1
  ENSP ID: ENSP00000422704
MALVLGSLLLLGLCGNSFSGGQPSSTDAPKAWNYELPATN

SEQ ID NO: 67331 - protein, 14 aa, Homo sapiens
  Payload ID: 13424
  Gene Symbol: PROM1
  Gene Name: prominin 1
  ENSP ID: ENSP00000423793
MALVLGSLLLLGLC

SEQ ID NO: 67332 - protein, 65 aa, Homo sapiens
  Payload ID: 13424
  Gene Symbol: PROM1
  Gene Name: prominin 1
  ENSP ID: ENSP00000423860
  MOD_RES (1)..(1): Any amino acid
XVDVFLCSYIIDPLNLFWFGIGKATVFLLPALIFAVKLAKYYRRMDSEDVYDDVETIPMKNPSQH

SEQ ID NO: 67333 - protein, 54 aa, Homo sapiens
  Payload ID: 13424
  Gene Symbol: PROM1
  Gene Name: prominin 1
  ENSP ID: ENSP00000424569
  MOD_RES (1)..(1): Any amino acid
XQDSHKAGPIGILFELVHIFLYVVQPRDFPEDENTKAQIGEACSFKTLQPNESW

SEQ ID NO: 67334 - protein, 93 aa, Homo sapiens
  Payload ID: 13424
  Gene Symbol: PROM1
  Gene Name: prominin 1
  ENSP ID: ENSP00000424738
  MOD_RES (1)..(1): Any amino acid
XEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 67335 - protein, 57 aa, Homo sapiens
  Payload ID: 13424
  Gene Symbol: PROM1
  Gene Name: prominin 1
  ENSP ID: ENSP00000425927
MALVLGSLLLLGLCGNSFSGGQPSSTDAPKAWNYELPATNYETQDSHKAGPIGILFE

SEQ ID NO: 67336 - protein, 856 aa, Homo sapiens
  Payload ID: 13424
  Gene Symbol: PROM1
  Gene Name: prominin 1
  Uniprot ID: O43490
  ENSP ID: ENSP00000426090
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 67337 - protein, 865 aa, Homo sapiens; identical to SEQ ID NO: 67329
  Payload ID: 13424
  Gene Symbol: PROM1
  Gene Name: prominin 1
  Uniprot ID: O43490
  ENSP ID: ENSP00000426809

SEQ ID NO: 67338 - protein, 856 aa, Homo sapiens; identical to SEQ ID NO: 67336
  Payload ID: 13424
  Gene Symbol: PROM1
  Gene Name: prominin 1
  Uniprot ID: O43490
  ENSP ID: ENSP00000427346

SEQ ID NO: 67339 - protein, 842 aa, Homo sapiens
  Payload ID: 13424
  Gene Symbol: PROM1
  Gene Name: prominin 1
  Uniprot ID: O43490
  ENSP ID: ENSP00000438045
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 67340 - protein, 834 aa, Homo sapiens
  Payload ID: 13424
  Gene Symbol: PROM1
  Gene Name: prominin 1
  Uniprot ID: O43490
  ENSP ID: ENSP00000443620
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 67341 - protein, 834 aa, Homo sapiens
  Payload ID: 13425
  Gene Symbol: PROM2
  Gene Name: prominin 2
  Uniprot ID: Q8N271
  ENSP ID: ENSP00000318270
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 67342 - protein, 834 aa, Homo sapiens; identical to SEQ ID NO: 67341
  Payload ID: 13425
  Gene Symbol: PROM2
  Gene Name: prominin 2
  Uniprot ID: Q8N271
  ENSP ID: ENSP00000318520

SEQ ID NO: 67343 - protein, 834 aa, Homo sapiens; identical to SEQ ID NO: 67341
  Payload ID: 13425
  Gene Symbol: PROM2
  Gene Name: prominin 2
  Uniprot ID: Q8N271
  ENSP ID: ENSP00000385716

SEQ ID NO: 67344 - protein, 169 aa, Homo sapiens
  Payload ID: 13425
  Gene Symbol: PROM2
  Gene Name: prominin 2
  ENSP ID: ENSP00000402753
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEAEARAGQWGSGHPSCPAACPGGAVRGGLRGMRCDRGPLPAAGAHCRALLLLLPLPPALRGTSEDRAQGAGL

SEQ ID NO: 67345 - protein, 882 aa, Homo sapiens
  Payload ID: 13426
  Gene Symbol: PML
  Gene Name: promyelocytic leukemia
  Uniprot ID: P29590
  ENSP ID: ENSP00000268058
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 67346 - protein, 829 aa, Homo sapiens
  Payload ID: 13426
  Gene Symbol: PML
  Gene Name: promyelocytic leukemia
  Uniprot ID: P29590
  ENSP ID: ENSP00000268059
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 67347 - protein, 781 aa, Homo sapiens
  Payload ID: 13426
  Gene Symbol: PML
  Gene Name: promyelocytic leukemia
  Uniprot ID: P29590
  ENSP ID: ENSP00000315434
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 67348 - protein, 423 aa, Homo sapiens
  Payload ID: 13426
  Gene Symbol: PML
  Gene Name: promyelocytic leukemia
  Uniprot ID: P29590
  ENSP ID: ENSP00000353004
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLRNALW

SEQ ID NO: 67349 - protein, 435 aa, Homo sapiens
  Payload ID: 13426
  Gene Symbol: PML
  Gene Name: promyelocytic leukemia
  Uniprot ID: P29590
  ENSP ID: ENSP00000378564
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLLPPPAHALTGPAQSSTH

SEQ ID NO: 67350 - protein, 633 aa, Homo sapiens
  Payload ID: 13426
  Gene Symbol: PML
  Gene Name: promyelocytic leukemia
  Uniprot ID: P29590
  ENSP ID: ENSP00000378567
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 67351 - protein, 560 aa, Homo sapiens
  Payload ID: 13426
  Gene Symbol: PML
  Gene Name: promyelocytic leukemia
  Uniprot ID: P29590
  ENSP ID: ENSP00000394642
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAGRERNALW

SEQ ID NO: 67352 - protein, 611 aa, Homo sapiens
  Payload ID: 13426
  Gene Symbol: PML
  Gene Name: promyelocytic leukemia
  Uniprot ID: P29590
  ENSP ID: ENSP00000395576
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 67353 - protein, 641 aa, Homo sapiens
  Payload ID: 13426
  Gene Symbol: PML
  Gene Name: promyelocytic leukemia
  Uniprot ID: P29590
  ENSP ID: ENSP00000455612
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSSSPQSEVLYWKVHGAHGDRRATVLASPLLASPLLASPLLASPVSAESTRSLQPALWHIPPPSLASPPAR

SEQ ID NO: 67354 - protein, 834 aa, Homo sapiens
  Payload ID: 13426
  Gene Symbol: PML
  Gene Name: promyelocytic leukemia
  Uniprot ID: P29590
  ENSP ID: ENSP00000455838
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 67355 - protein, 423 aa, Homo sapiens; identical to SEQ ID NO: 67348
  Payload ID: 13426
  Gene Symbol: PML
  Gene Name: promyelocytic leukemia
  Uniprot ID: P29590
  ENSP ID: ENSP00000456277

SEQ ID NO: 67356 - protein, 110 aa, Homo sapiens
  Payload ID: 13426
  Gene Symbol: PML
  Gene Name: promyelocytic leukemia
  ENSP ID: ENSP00000456329
SPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAGRERNALW

SEQ ID NO: 67357 - protein, 560 aa, Homo sapiens; identical to SEQ ID NO: 67351
  Payload ID: 13426
  Gene Symbol: PML
  Gene Name: promyelocytic leukemia
  Uniprot ID: P29590
  ENSP ID: ENSP00000456486

SEQ ID NO: 67358 - protein, 240 aa, Homo sapiens
  Payload ID: 13426
  Gene Symbol: PML
  Gene Name: promyelocytic leukemia
  ENSP ID: ENSP00000456989
  MOD_RES (1)..(1): Any amino acid
XSAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPAQSSTH

SEQ ID NO: 67359 - protein, 585 aa, Homo sapiens
  Payload ID: 13426
  Gene Symbol: PML
  Gene Name: promyelocytic leukemia
  Uniprot ID: P29590
  ENSP ID: ENSP00000457023
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 67360 - protein, 568 aa, Homo sapiens
  Payload ID: 13426
  Gene Symbol: PML
  Gene Name: promyelocytic leukemia
  ENSP ID: ENSP00000457032
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAGREVGRAVAWVLPARVWAVPLFCILAPSRKPKANRSPLFPLNKIGKVHSVRGGESGHSLPCVLP

SEQ ID NO: 67361 - protein, 261 aa, Homo sapiens
  Payload ID: 13426
  Gene Symbol: PML
  Gene Name: promyelocytic leukemia
  ENSP ID: ENSP00000457669
  MOD_RES (1)..(1): Any amino acid
XAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAGRERNALW

SEQ ID NO: 67362 - protein, 217 aa, Homo sapiens
  Payload ID: 13426
  Gene Symbol: PML
  Gene Name: promyelocytic leukemia
  ENSP ID: ENSP00000458061
  MOD_RES (1)..(1): Any amino acid
XRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSPSV

SEQ ID NO: 67363 - protein, 267 aa, Homo sapiens
  Payload ID: 13427
  Gene Symbol: POMC
  Gene Name: proopiomelanocortin
  Uniprot ID: P01189
  ENSP ID: ENSP00000264708
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 67364 - protein, 267 aa, Homo sapiens; identical to SEQ ID NO: 67363
  Payload ID: 13427
  Gene Symbol: POMC
  Gene Name: proopiomelanocortin
  Uniprot ID: P01189
  ENSP ID: ENSP00000370171

SEQ ID NO: 67365 - protein, 267 aa, Homo sapiens; identical to SEQ ID NO: 67363
  Payload ID: 13427
  Gene Symbol: POMC
  Gene Name: proopiomelanocortin
  Uniprot ID: P01189
  ENSP ID: ENSP00000379170

SEQ ID NO: 67366 - protein, 267 aa, Homo sapiens; identical to SEQ ID NO: 67363
  Payload ID: 13427
  Gene Symbol: POMC
  Gene Name: proopiomelanocortin
  Uniprot ID: P01189
  ENSP ID: ENSP00000384092

SEQ ID NO: 67367 - protein, 246 aa, Homo sapiens
  Payload ID: 13427
  Gene Symbol: POMC
  Gene Name: proopiomelanocortin
  ENSP ID: ENSP00000387993
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKS

SEQ ID NO: 67368 - protein, 226 aa, Homo sapiens
  Payload ID: 13428
  Gene Symbol: PROP1
  Gene Name: PROP paired-like homeobox 1
  Uniprot ID: O75360
  ENSP ID: ENSP00000311290
MEAERRRQAEKPKKGRVGSNLLPERHPATGTPTTTVDSSAPPCRRLPGAGGGRSRFSPQGGQRGRPHSRRRHRTTFSPVQLEQLESAFGRNQYPDIWARESLARDTGLSEARIQVWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 67369 - protein, 226 aa, Homo sapiens
  Payload ID: 13428
  Gene Symbol: PROP1
  Gene Name: PROP paired-like homeobox 1
  ENSP ID: ENSP00000484677
MEAERRRQAEKPKKGRVGSSLLPERHPATGTPTTTVDSSAPPCRRLPGAGGGRSRFSPQGGQRGRPHSRRRHRTTFSPVQLEQLESAFGRNQYPDIWARESLARDTGLSEARIQVWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 67370 - protein, 112 aa, Homo sapiens
  Payload ID: 13428
  Gene Symbol: PROP1
  Gene Name: PROP paired-like homeobox 1
  ENSP ID: ENSP00000486962
VWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 67371 - protein, 681 aa, Homo sapiens
  Payload ID: 13429
  Gene Symbol: PCCA
  Gene Name: propionyl CoA carboxylase, alpha polypeptide
  Uniprot ID: P05165
  ENSP ID: ENSP00000365456
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVVAEGQEICVIEAMKMQNSMTAGKTGTVKSVHCQAGDTVGEGDLLVELE

SEQ ID NO: 67372 - protein, 728 aa, Homo sapiens
  Payload ID: 13429
  Gene Symbol: PCCA
  Gene Name: propionyl CoA carboxylase, alpha polypeptide
  Uniprot ID: P05165
  ENSP ID: ENSP00000365462
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 67373 - protein, 702 aa, Homo sapiens
  Payload ID: 13429
  Gene Symbol: PCCA
  Gene Name: propionyl CoA carboxylase, alpha polypeptide
  Uniprot ID: P05165
  ENSP ID: ENSP00000365463
MAGFWVGTAPLVAAGRRGRWPPQQLMLSAALRTLKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 67374 - protein, 134 aa, Homo sapiens
  Payload ID: 13429
  Gene Symbol: PCCA
  Gene Name: propionyl CoA carboxylase, alpha polypeptide
  ENSP ID: ENSP00000390850
  MOD_RES (1)..(1): Any amino acid
XMPVIKPDIANWELSVKLHDKVHTVVASNNGSVFSVEVDGSKLNVTSTWNLASPLLSVSVDGTQRTVQCLSREAGGNMSIQFLGTVVAEGQEICVIEAMKMQNSMTAGKTGTVKSVHCQAGDTVGEGDLLVELE

SEQ ID NO: 67375 - protein, 149 aa, Homo sapiens
  Payload ID: 13429
  Gene Symbol: PCCA
  Gene Name: propionyl CoA carboxylase, alpha polypeptide
  ENSP ID: ENSP00000396050
GGIYFYHGRKGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQ

SEQ ID NO: 67376 - protein, 111 aa, Homo sapiens
  Payload ID: 13429
  Gene Symbol: PCCA
  Gene Name: propionyl CoA carboxylase, alpha polypeptide
  ENSP ID: ENSP00000399413
YKVNILTRLAAELNKFMLEKVTEDTSSVLRSPMPGVVVAVSVKPGDAATSSLSVEICLFWTFQVAEGQEICVIEAMKMQNSMTAGKTGTVKSVHCQAGDTVGEGDLLVELE

SEQ ID NO: 67377 - protein, 139 aa, Homo sapiens
  Payload ID: 13429
  Gene Symbol: PCCA
  Gene Name: propionyl CoA carboxylase, alpha polypeptide
  ENSP ID: ENSP00000400740
  MOD_RES (1)..(1): Any amino acid
XNISLCPEICFQKIESQVYFVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENS

SEQ ID NO: 67378 - protein, 84 aa, Homo sapiens
  Payload ID: 13429
  Gene Symbol: PCCA
  Gene Name: propionyl CoA carboxylase, alpha polypeptide
  ENSP ID: ENSP00000411194
  MOD_RES (1)..(1): Any amino acid
XNWELSVKLHDKVHTVVASNNGSVFSVEVDGSKLNVTSTWNLASPLLSVSVDGTQRTVQCLSREAGGNMSIQFLGTVPWRKLLD

SEQ ID NO: 67379 - protein, 539 aa, Homo sapiens
  Payload ID: 13430
  Gene Symbol: PCCB
  Gene Name: propionyl CoA carboxylase, beta polypeptide
  Uniprot ID: P05166
  ENSP ID: ENSP00000251654
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67380 - protein, 423 aa, Homo sapiens
  Payload ID: 13430
  Gene Symbol: PCCB
  Gene Name: propionyl CoA carboxylase, beta polypeptide
  ENSP ID: ENSP00000417253
MAAALRVAAVGARLSVLASGLRAAVRSLCSQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67381 - protein, 550 aa, Homo sapiens
  Payload ID: 13430
  Gene Symbol: PCCB
  Gene Name: propionyl CoA carboxylase, beta polypeptide
  ENSP ID: ENSP00000417549
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVRVQEVFHQVVQSGHRDGRGAVRW

SEQ ID NO: 67382 - protein, 405 aa, Homo sapiens
  Payload ID: 13430
  Gene Symbol: PCCB
  Gene Name: propionyl CoA carboxylase, beta polypeptide
  ENSP ID: ENSP00000417937
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGLWRCL

SEQ ID NO: 67383 - protein, 84 aa, Homo sapiens
  Payload ID: 13430
  Gene Symbol: PCCB
  Gene Name: propionyl CoA carboxylase, beta polypeptide
  ENSP ID: ENSP00000418020
MFVEHRCADFGMAADKNKFPGDSVVTGRGRINGRLVYVFSQDFTVFGGSLSGAHAQKICKIMDQAITVGAPVIGLNDSGGARIQ

SEQ ID NO: 67384 - protein, 482 aa, Homo sapiens
  Payload ID: 13430
  Gene Symbol: PCCB
  Gene Name: propionyl CoA carboxylase, beta polypeptide
  ENSP ID: ENSP00000418307
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67385 - protein, 559 aa, Homo sapiens
  Payload ID: 13430
  Gene Symbol: PCCB
  Gene Name: propionyl CoA carboxylase, beta polypeptide
  Uniprot ID: P05166
  ENSP ID: ENSP00000419027
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQQIIGWAQWLPLVISALWEAEDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67386 - protein, 570 aa, Homo sapiens
  Payload ID: 13430
  Gene Symbol: PCCB
  Gene Name: propionyl CoA carboxylase, beta polypeptide
  ENSP ID: ENSP00000419129
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQIRASAMSPRLVSDSWTQAIHLPWPPKVLGLQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67387 - protein, 191 aa, Homo sapiens
  Payload ID: 13430
  Gene Symbol: PCCB
  Gene Name: propionyl CoA carboxylase, beta polypeptide
  ENSP ID: ENSP00000419263
MAAALRVAAVGARLSVLASGLRAAVRSLCSQATSVNERIENKRRTALLGGGQRRIDAQHKRARVQQLTATSASQLQAILLPQPPEYLGLQGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSG

SEQ ID NO: 67388 - protein, 133 aa, Homo sapiens
  Payload ID: 13430
  Gene Symbol: PCCB
  Gene Name: propionyl CoA carboxylase, beta polypeptide
  ENSP ID: ENSP00000419293
MFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFM

SEQ ID NO: 67389 - protein, 163 aa, Homo sapiens
  Payload ID: 13430
  Gene Symbol: PCCB
  Gene Name: propionyl CoA carboxylase, beta polypeptide
  ENSP ID: ENSP00000419563
  MOD_RES (1)..(1): Any amino acid
XESSWPSEISWAAHFGEGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYS

SEQ ID NO: 67390 - protein, 559 aa, Homo sapiens
  Payload ID: 13430
  Gene Symbol: PCCB
  Gene Name: propionyl CoA carboxylase, beta polypeptide
  ENSP ID: ENSP00000420158
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASDSISFTPWNYARRQYRPYFAGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67391 - protein, 516 aa, Homo sapiens
  Payload ID: 13430
  Gene Symbol: PCCB
  Gene Name: propionyl CoA carboxylase, beta polypeptide
  ENSP ID: ENSP00000420391
MAAALRVAAVGARLSVLASGLRAAVRSLCSQATSVNERIENKRRTALLGGGQRRIDAQHKRGKLTARERISLLLDPGSFVESDMFVEHRCADFGMAADKNKDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67392 - protein, 520 aa, Homo sapiens
  Payload ID: 13430
  Gene Symbol: PCCB
  Gene Name: propionyl CoA carboxylase, beta polypeptide
  ENSP ID: ENSP00000420639
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 67393 - protein, 303 aa, Homo sapiens
  Payload ID: 13430
  Gene Symbol: PCCB
  Gene Name: propionyl CoA carboxylase, beta polypeptide
  ENSP ID: ENSP00000420759
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSPTFCLWLH

SEQ ID NO: 67394 - protein, 128 aa, Homo sapiens
  Payload ID: 13431
  Gene Symbol: PPBP
  Gene Name: pro-platelet basic protein (chemokine (C-X-C motif) ligand 7)
  Uniprot ID: P02775
  ENSP ID: ENSP00000296028
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 67395 - protein, 753 aa, Homo sapiens
  Payload ID: 13432
  Gene Symbol: PCSK1
  Gene Name: proprotein convertase subtilisin/kexin type 1
  Uniprot ID: P29120
  ENSP ID: ENSP00000308024
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 67396 - protein, 706 aa, Homo sapiens
  Payload ID: 13432
  Gene Symbol: PCSK1
  Gene Name: proprotein convertase subtilisin/kexin type 1
  Uniprot ID: P29120
  ENSP ID: ENSP00000421600
MGKGSISFLFFSQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 67397 - protein, 157 aa, Homo sapiens
  Payload ID: 13432
  Gene Symbol: PCSK1
  Gene Name: proprotein convertase subtilisin/kexin type 1
  ENSP ID: ENSP00000427294
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGIT

SEQ ID NO: 67398 - protein, 260 aa, Homo sapiens
  Payload ID: 13433
  Gene Symbol: PCSK1N
  Gene Name: proprotein convertase subtilisin/kexin type 1 inhibitor
  Uniprot ID: Q9UHG2
  ENSP ID: ENSP00000218230
MAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 67399 - protein, 638 aa, Homo sapiens
  Payload ID: 13434
  Gene Symbol: PCSK2
  Gene Name: proprotein convertase subtilisin/kexin type 2
  Uniprot ID: P16519
  ENSP ID: ENSP00000262545
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 67400 - protein, 619 aa, Homo sapiens
  Payload ID: 13434
  Gene Symbol: PCSK2
  Gene Name: proprotein convertase subtilisin/kexin type 2
  Uniprot ID: P16519
  ENSP ID: ENSP00000367131
MVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 67401 - protein, 603 aa, Homo sapiens
  Payload ID: 13434
  Gene Symbol: PCSK2
  Gene Name: proprotein convertase subtilisin/kexin type 2
  Uniprot ID: P16519
  ENSP ID: ENSP00000437458
MKGGCVSQWKAAAGFLFCVMVFASAERPVFTNHFLVELHKGGEDKARQVAAEHGFGVRKVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 67402 - protein, 755 aa, Homo sapiens
  Payload ID: 13435
  Gene Symbol: PCSK4
  Gene Name: proprotein convertase subtilisin/kexin type 4
  Uniprot ID: Q6UW60
  ENSP ID: ENSP00000300954
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 67403 - protein, 318 aa, Homo sapiens
  Payload ID: 13435
  Gene Symbol: PCSK4
  Gene Name: proprotein convertase subtilisin/kexin type 4
  ENSP ID: ENSP00000465102
  MOD_RES (1)..(1): Any amino acid
XPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRRTDAGRYHHRCHRGPVAEPAAAAHPHLQRQLGSRGRRPHGGRPRHPHPRGLPAWCDQASTRFPWAAPPSRAACPGTAKPAPPPSPPPTAAAWPPTPRSSPRTCITGAQTSTRAPRPQPHWRPA

SEQ ID NO: 67404 - protein, 229 aa, Homo sapiens
  Payload ID: 13435
  Gene Symbol: PCSK4
  Gene Name: proprotein convertase subtilisin/kexin type 4
  ENSP ID: ENSP00000466742
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRRTDAGRYHHRCHRGPVAEPAAAAHPHLQRQL

SEQ ID NO: 67405 - protein, 913 aa, Homo sapiens
  Payload ID: 13436
  Gene Symbol: PCSK5
  Gene Name: proprotein convertase subtilisin/kexin type 5
  Uniprot ID: Q92824
  ENSP ID: ENSP00000365943
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 67406 - protein, 690 aa, Homo sapiens
  Payload ID: 13436
  Gene Symbol: PCSK5
  Gene Name: proprotein convertase subtilisin/kexin type 5
  ENSP ID: ENSP00000365958
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGELASSGTQAKKRQLMHHPTTWENRMEWNGMKWNGMKWNGMEWNGMEWNRIESNRIE

SEQ ID NO: 67407 - protein, 101 aa, Homo sapiens
  Payload ID: 13436
  Gene Symbol: PCSK5
  Gene Name: proprotein convertase subtilisin/kexin type 5
  ENSP ID: ENSP00000407239
CQPCHRFCATCAGAGADGCINCTEGYFMEDGRCVQSCSISYYFDHSSENGYKSCKKCDISCLTCNGPGFKNCTSCPSGYLLDLGMCQMGAICKDVSLFRGA

SEQ ID NO: 67408 - protein, 1560 aa, Homo sapiens
  Payload ID: 13436
  Gene Symbol: PCSK5
  Gene Name: proprotein convertase subtilisin/kexin type 5
  ENSP ID: ENSP00000411654
NSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 67409 - protein, 1860 aa, Homo sapiens
  Payload ID: 13436
  Gene Symbol: PCSK5
  Gene Name: proprotein convertase subtilisin/kexin type 5
  Uniprot ID: Q92824
  ENSP ID: ENSP00000446280
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 67410 - protein, 664 aa, Homo sapiens
  Payload ID: 13437
  Gene Symbol: PCSK6
  Gene Name: proprotein convertase subtilisin/kexin type 6
  ENSP ID: ENSP00000332052
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 67411 - protein, 797 aa, Homo sapiens
  Payload ID: 13437
  Gene Symbol: PCSK6
  Gene Name: proprotein convertase subtilisin/kexin type 6
  ENSP ID: ENSP00000381246
QIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEAKSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 67412 - protein, 77 aa, Homo sapiens
  Payload ID: 13437
  Gene Symbol: PCSK6
  Gene Name: proprotein convertase subtilisin/kexin type 6
  ENSP ID: ENSP00000452839
  MOD_RES (1)..(1): Any amino acid
XGLPHKVCRRCDENCLSCAGSSRNCSRCKTGFTQLGTSCITNHTCSNGDIWQRLETFWVVTTGRMYSHPVGGGQECC

SEQ ID NO: 67413 - protein, 345 aa, Homo sapiens
  Payload ID: 13437
  Gene Symbol: PCSK6
  Gene Name: proprotein convertase subtilisin/kexin type 6
  ENSP ID: ENSP00000452997
  MOD_RES (1)..(1): Any amino acid
XGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHK

SEQ ID NO: 67414 - protein, 126 aa, Homo sapiens
  Payload ID: 13437
  Gene Symbol: PCSK6
  Gene Name: proprotein convertase subtilisin/kexin type 6
  ENSP ID: ENSP00000453155
  MOD_RES (1)..(1): Any amino acid
XALGPAGGLLGARGGSHLHLTPTPRRPPDLPGFSLGNQVSTSGKEVEVPEDEEDYTGVCHPECGDKGCDGPNADQCLNCVHFSLGSVKTSRKCVSVCPLGYFGDTAARRCRRCHKGCETCSSRAAT

SEQ ID NO: 67415 - protein, 125 aa, Homo sapiens
  Payload ID: 13437
  Gene Symbol: PCSK6
  Gene Name: proprotein convertase subtilisin/kexin type 6
  ENSP ID: ENSP00000453771
AEGQWTLEIQDLPSQVRNPEKQGKLKEWSLILYGTAEHPYHTFSAHQSRSRMLELSAPELEPPKAALSPSQVEVPEDEEDYTAQSTPGSANILQTRDIWQRLETFWVVTTGRMYSHPVGGGQECC

SEQ ID NO: 67416 - protein, 652 aa, Homo sapiens
  Payload ID: 13437
  Gene Symbol: PCSK6
  Gene Name: proprotein convertase subtilisin/kexin type 6
  Uniprot ID: P29122
  ENSP ID: ENSP00000477768
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 67417 - protein, 623 aa, Homo sapiens
  Payload ID: 13437
  Gene Symbol: PCSK6
  Gene Name: proprotein convertase subtilisin/kexin type 6
  Uniprot ID: P29122
  ENSP ID: ENSP00000478081
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGNLD

SEQ ID NO: 67418 - protein, 956 aa, Homo sapiens
  Payload ID: 13437
  Gene Symbol: PCSK6
  Gene Name: proprotein convertase subtilisin/kexin type 6
  Uniprot ID: P29122
  ENSP ID: ENSP00000479496
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 67419 - protein, 975 aa, Homo sapiens
  Payload ID: 13437
  Gene Symbol: PCSK6
  Gene Name: proprotein convertase subtilisin/kexin type 6
  ENSP ID: ENSP00000481556
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 67420 - protein, 969 aa, Homo sapiens
  Payload ID: 13437
  Gene Symbol: PCSK6
  Gene Name: proprotein convertase subtilisin/kexin type 6
  Uniprot ID: P29122
  ENSP ID: ENSP00000482760
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 67421 - protein, 962 aa, Homo sapiens
  Payload ID: 13437
  Gene Symbol: PCSK6
  Gene Name: proprotein convertase subtilisin/kexin type 6
  ENSP ID: ENSP00000482831
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 67422 - protein, 142 aa, Homo sapiens
  Payload ID: 13437
  Gene Symbol: PCSK6
  Gene Name: proprotein convertase subtilisin/kexin type 6
  ENSP ID: ENSP00000483048
  MOD_RES (1)..(1): Any amino acid
XLTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 67423 - protein, 308 aa, Homo sapiens
  Payload ID: 13437
  Gene Symbol: PCSK6
  Gene Name: proprotein convertase subtilisin/kexin type 6
  ENSP ID: ENSP00000487813
MLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 67424 - protein, 785 aa, Homo sapiens
  Payload ID: 13438
  Gene Symbol: PCSK7
  Gene Name: proprotein convertase subtilisin/kexin type 7
  Uniprot ID: Q16549
  ENSP ID: ENSP00000325917
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 67425 - protein, 305 aa, Homo sapiens
  Payload ID: 13438
  Gene Symbol: PCSK7
  Gene Name: proprotein convertase subtilisin/kexin type 7
  ENSP ID: ENSP00000431181
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGK

SEQ ID NO: 67426 - protein, 91 aa, Homo sapiens
  Payload ID: 13438
  Gene Symbol: PCSK7
  Gene Name: proprotein convertase subtilisin/kexin type 7
  ENSP ID: ENSP00000433252
MPKGRQKVPHLDAPLGLPTCLWLELAGLFLLVPWVMGLAGTGGPDGQGTGGPSWAVHLESLEGDGEEETLEQQADALAQAAGLVNAGRIGE

SEQ ID NO: 67427 - protein, 113 aa, Homo sapiens
  Payload ID: 13438
  Gene Symbol: PCSK7
  Gene Name: proprotein convertase subtilisin/kexin type 7
  ENSP ID: ENSP00000433841
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAI

SEQ ID NO: 67428 - protein, 92 aa, Homo sapiens
  Payload ID: 13438
  Gene Symbol: PCSK7
  Gene Name: proprotein convertase subtilisin/kexin type 7
  ENSP ID: ENSP00000436459
MPKGRQKVPHLDAPLGLPTCLWLELAGLFLLVPWVMGLAGTGGPDGQGTGGPSWAVHLESLEGDGEEETLEQQADALAQAAGLVNAGRIGEL

SEQ ID NO: 67429 - protein, 591 aa, Homo sapiens
  Payload ID: 13438
  Gene Symbol: PCSK7
  Gene Name: proprotein convertase subtilisin/kexin type 7
  ENSP ID: ENSP00000441944
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSWLCVECSRHQGQTKAVRECHEWKIPAR

SEQ ID NO: 67430 - protein, 692 aa, Homo sapiens
  Payload ID: 13439
  Gene Symbol: PCSK9
  Gene Name: proprotein convertase subtilisin/kexin type 9
  Uniprot ID: Q8NBP7
  ENSP ID: ENSP00000303208
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 67431 - protein, 527 aa, Homo sapiens [sequence omitted]

SEQ ID NO: 67432 - protein, 524 aa, Homo sapiens
  Payload ID: 13440
  Gene Symbol: PSAP
  Gene Name: prosaposin
  Uniprot ID: P07602
  ENSP ID: ENSP00000378394
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 67433 - protein, 240 aa, Homo sapiens
  Payload ID: 13440
  Gene Symbol: PSAP
  Gene Name: prosaposin
  ENSP ID: ENSP00000480857
MYALFLLASLLGAALAGPVLGLKECTRGSAVWCQNVKTASDCGAVKHCLQTVWNKPTVKSLPCDICKDVVTAAGDMLKDNATEEEILVYLEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 67434 - protein, 167 aa, Homo sapiens
  Payload ID: 13440
  Gene Symbol: PSAP
  Gene Name: prosaposin
  ENSP ID: ENSP00000488331
  MOD_RES (1)..(1): Any amino acid
XCIQMVTDIQTAVRTNSTFVQALVEHVKEECDRLGPGMADICKNYISQYSEIAIQMMMHMQDQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDT

SEQ ID NO: 67435 - protein, 521 aa, Homo sapiens
  Payload ID: 13441
  Gene Symbol: PSAPL1
  Gene Name: prosaposin-like 1 (gene/pseudogene)
  Uniprot ID: Q6NUJ1
  ENSP ID: ENSP00000317445
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 67436 - protein, 737 aa, Homo sapiens
  Payload ID: 13442
  Gene Symbol: PROX1
  Gene Name: prospero homeobox 1
  Uniprot ID: Q92786
  ENSP ID: ENSP00000261454
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 67437 - protein, 737 aa, Homo sapiens; identical to SEQ ID NO: 67436
  Payload ID: 13442
  Gene Symbol: PROX1
  Gene Name: prospero homeobox 1
  Uniprot ID: Q92786
  ENSP ID: ENSP00000355925

SEQ ID NO: 67438 - protein, 737 aa, Homo sapiens; identical to SEQ ID NO: 67436
  Payload ID: 13442
  Gene Symbol: PROX1
  Gene Name: prospero homeobox 1
  Uniprot ID: Q92786
  ENSP ID: ENSP00000400694

SEQ ID NO: 67439 - protein, 230 aa, Homo sapiens
  Payload ID: 13442
  Gene Symbol: PROX1
  Gene Name: prospero homeobox 1
  ENSP ID: ENSP00000419517
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKE

SEQ ID NO: 67440 - protein, 737 aa, Homo sapiens; identical to SEQ ID NO: 67436
  Payload ID: 13442
  Gene Symbol: PROX1
  Gene Name: prospero homeobox 1
  Uniprot ID: Q92786
  ENSP ID: ENSP00000420283

SEQ ID NO: 67441 - protein, 143 aa, Homo sapiens
  Payload ID: 13442
  Gene Symbol: PROX1
  Gene Name: prospero homeobox 1
  ENSP ID: ENSP00000475357
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSP

SEQ ID NO: 67442 - protein, 592 aa, Homo sapiens
  Payload ID: 13443
  Gene Symbol: PROX2
  Gene Name: prospero homeobox 2
  ENSP ID: ENSP00000451223
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLVHIQEGLNPGHLKKAKLMFFFTRYPSSNLLKVYFPDVQFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 67443 - protein, 365 aa, Homo sapiens
  Payload ID: 13443
  Gene Symbol: PROX2
  Gene Name: prospero homeobox 2
  Uniprot ID: Q3B8N5
  ENSP ID: ENSP00000451463
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 67444 - protein, 8 aa, Homo sapiens
  Payload ID: 13443
  Gene Symbol: PROX2
  Gene Name: prospero homeobox 2
  ENSP ID: ENSP00000478947
MDPNSILL

SEQ ID NO: 67445 - protein, 359 aa, Homo sapiens
  Payload ID: 13444
  Gene Symbol: PTGDR
  Gene Name: prostaglandin D2 receptor (DP)
  Uniprot ID: Q13258
  ENSP ID: ENSP00000303424
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 67446 - protein, 296 aa, Homo sapiens
  Payload ID: 13444
  Gene Symbol: PTGDR
  Gene Name: prostaglandin D2 receptor (DP)
  Uniprot ID: Q13258
  ENSP ID: ENSP00000452408
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIAFVPGVPAKTPGSR

SEQ ID NO: 67447 - protein, 395 aa, Homo sapiens
  Payload ID: 13445
  Gene Symbol: PTGDR2
  Gene Name: prostaglandin D2 receptor 2
  Uniprot ID: Q9Y5Y4
  ENSP ID: ENSP00000332812
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQVALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 67448 - protein, 190 aa, Homo sapiens
  Payload ID: 13446
  Gene Symbol: PTGDS
  Gene Name: prostaglandin D2 synthase 21kDa (brain)
  Uniprot ID: P41222
  ENSP ID: ENSP00000360687
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 67449 - protein, 195 aa, Homo sapiens
  Payload ID: 13446
  Gene Symbol: PTGDS
  Gene Name: prostaglandin D2 synthase 21kDa (brain)
  ENSP ID: ENSP00000392633
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGDWGSTYSVSVVETDYDQYALLYSQGSKGPGEDFRMATLYSRTQTPRAELKE

SEQ ID NO: 67450 - protein, 62 aa, Homo sapiens
  Payload ID: 13446
  Gene Symbol: PTGDS
  Gene Name: prostaglandin D2 synthase 21kDa (brain)
  ENSP ID: ENSP00000392692
  MOD_RES (1)..(1): Any amino acid
XGYHCLPAPNRAQGEVGGDGGSVQFGGSVKTSSALREEQEAQWENWPKSGVLTTAPGFFLGR

SEQ ID NO: 67451 - protein, 124 aa, Homo sapiens
  Payload ID: 13446
  Gene Symbol: PTGDS
  Gene Name: prostaglandin D2 synthase 21kDa (brain)
  ENSP ID: ENSP00000397468
VVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTAPGFFLGR

SEQ ID NO: 67452 - protein, 190 aa, Homo sapiens; identical to SEQ ID NO: 67448
  Payload ID: 13446
  Gene Symbol: PTGDS
  Gene Name: prostaglandin D2 synthase 21kDa (brain)
  Uniprot ID: P41222
  ENSP ID: ENSP00000435033

SEQ ID NO: 67453 - protein, 402 aa, Homo sapiens
  Payload ID: 13447
  Gene Symbol: PTGER1
  Gene Name: prostaglandin E receptor 1 (subtype EP1), 42kDa
  Uniprot ID: P34995
  ENSP ID: ENSP00000292513
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 67454 - protein, 358 aa, Homo sapiens
  Payload ID: 13448
  Gene Symbol: PTGER2
  Gene Name: prostaglandin E receptor 2 (subtype EP2), 53kDa
  Uniprot ID: P43116
  ENSP ID: ENSP00000245457
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 67455 - protein, 103 aa, Homo sapiens
  Payload ID: 13448
  Gene Symbol: PTGER2
  Gene Name: prostaglandin E receptor 2 (subtype EP2), 53kDa
  ENSP ID: ENSP00000450933
MAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 67456 - protein, 390 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000280208
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQIRYHTNNYASSSTSLPCQCSSTLMWSDHLER

SEQ ID NO: 67457 - protein, 390 aa, Homo sapiens; identical to SEQ ID NO: 67456
  Payload ID: 13449
  Gene Symbol: PTGER3
  Gene Name: prostaglandin E receptor 3 (subtype EP3)
  Uniprot ID: P43115
  ENSP ID: ENSP00000302313

SEQ ID NO: 67458 - protein, 412 aa, Homo sapiens [sequence omitted]

SEQ ID NO: 67459 - protein, 418 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000349003
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQLICSLQNSQIQRATAHCGQVQTYRVLNREEMEVLVSSINVYTRISTVKTE

SEQ ID NO: 67460 - protein, 388 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000359962
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEA

SEQ ID NO: 67461 - protein, 390 aa, Homo sapiens; identical to SEQ ID NO: 67456
  Payload ID: 13449
  Gene Symbol: PTGER3
  Gene Name: prostaglandin E receptor 3 (subtype EP3)
  Uniprot ID: P43115
  ENSP ID: ENSP00000359969

SEQ ID NO: 67462 - protein, 388 aa, Homo sapiens
  Payload ID: 13449
  Gene Symbol: PTGER3
  Gene Name: prostaglandin E receptor 3 (subtype EP3)
  ENSP ID: ENSP00000359970
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSFSRRNFGEIKTCLSARITSLEAP

SEQ ID NO: 67463 - protein, 374 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000418073
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEEFWGN

SEQ ID NO: 67464 - protein, 393 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000421583
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEMGPDGRCFCHAWRQVPRTWCSSHDREPCSVQLS

SEQ ID NO: 67465 - protein, 425 aa, Homo sapiens
  Payload ID: 13449
  Gene Symbol: PTGER3
  Gene Name: prostaglandin E receptor 3 (subtype EP3)
  ENSP ID: ENSP00000423561
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQAPLLPTSTVIDPSRFCAQPFRWFLDLSFPAMSSSHPQLPLTLASFKLLREPCSVQLS

SEQ ID NO: 67466 - protein, 402 aa, Homo sapiens
  Payload ID: 13449
  Gene Symbol: PTGER3
  Gene Name: prostaglandin E receptor 3 (subtype EP3)
  ENSP ID: ENSP00000424340
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDREPCSVQLS

SEQ ID NO: 67467 - protein, 365 aa, Homo sapiens
  Payload ID: 13449
  Gene Symbol: PTGER3
  Gene Name: prostaglandin E receptor 3 (subtype EP3)
  Uniprot ID: P43115
  ENSP ID: ENSP00000486617
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEEFWGN

SEQ ID NO: 67468 - protein, 488 aa, Homo sapiens
  Payload ID: 13450
  Gene Symbol: PTGER4
  Gene Name: prostaglandin E receptor 4 (subtype EP4)
  Uniprot ID: P35408
  ENSP ID: ENSP00000302846
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 67469 - protein, 152 aa, Homo sapiens
  Payload ID: 13451
  Gene Symbol: PTGES
  Gene Name: prostaglandin E synthase
  Uniprot ID: O14684
  ENSP ID: ENSP00000342385
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 67470 - protein, 186 aa, Homo sapiens
  Payload ID: 13452
  Gene Symbol: PTGES2
  Gene Name: prostaglandin E synthase 2
  ENSP ID: ENSP00000277462
MKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 67471 - protein, 377 aa, Homo sapiens
  Payload ID: 13452
  Gene Symbol: PTGES2
  Gene Name: prostaglandin E synthase 2
  Uniprot ID: Q9H7Z7
  ENSP ID: ENSP00000345341
MDPAARVVRALWPGGCALAWRLGGRPQPLLPTQSRAGFAGAAGGPSPVAAARKGSPRLLGAAALALGGALGLYHTARWHLRAQDLHAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 67472 - protein, 265 aa, Homo sapiens
  Payload ID: 13452
  Gene Symbol: PTGES2
  Gene Name: prostaglandin E synthase 2
  ENSP ID: ENSP00000411378
MDPAARVVRALWPGGCALAWRLGGRPQPLLPTQSRAGFAGAAGGPSPVAAARKGSPRLLGAAALALGGALGLYHTARWHLRAQDLHAERSAAQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQ

SEQ ID NO: 67473 - protein, 186 aa, Homo sapiens; identical to SEQ ID NO: 67470
  Payload ID: 13452
  Gene Symbol: PTGES2
  Gene Name: prostaglandin E synthase 2
  ENSP ID: ENSP00000482913

SEQ ID NO: 67474 - protein, 160 aa, Homo sapiens
  Payload ID: 13453
  Gene Symbol: PTGES3
  Gene Name: prostaglandin E synthase 3 (cytosolic)
  Uniprot ID: Q15185
  ENSP ID: ENSP00000262033
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 67475 - protein, 124 aa, Homo sapiens
  Payload ID: 13453
  Gene Symbol: PTGES3
  Gene Name: prostaglandin E synthase 3 (cytosolic)
  ENSP ID: ENSP00000389090
MQPASAKWYDRRDYVFIEFCVEDSKDVNVNFEKSKLTFSCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 67476 - protein, 127 aa, Homo sapiens
  Payload ID: 13453
  Gene Symbol: PTGES3
  Gene Name: prostaglandin E synthase 3 (cytosolic)
  Uniprot ID: Q15185
  ENSP ID: ENSP00000402385
MQPASAKWYDRRDYVFIEFCVEDSKDVNVNFEKSKLTFSCLGGSDNFKHLNEIDLFHCIDPNLNWLSVDFNNWKDWEDDSDEDMSNFDRFSEMMNNMGGDEDVDLPEVDGADDDSQDSDDEKMPDLE

SEQ ID NO: 67477 - protein, 130 aa, Homo sapiens
  Payload ID: 13453
  Gene Symbol: PTGES3
  Gene Name: prostaglandin E synthase 3 (cytosolic)
  Uniprot ID: Q15185
  ENSP ID: ENSP00000405299
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKMMNNMGGDEDVDLPEVDGADDDSQDSDDEKMPDLE

SEQ ID NO: 67478 - protein, 139 aa, Homo sapiens
  Payload ID: 13453
  Gene Symbol: PTGES3
  Gene Name: prostaglandin E synthase 3 (cytosolic)
  Uniprot ID: Q15185
  ENSP ID: ENSP00000414892
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEDSQDSDDEKMPDLE

SEQ ID NO: 67479 - protein, 164 aa, Homo sapiens
  Payload ID: 13453
  Gene Symbol: PTGES3
  Gene Name: prostaglandin E synthase 3 (cytosolic)
  ENSP ID: ENSP00000482075
MSLEKQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 67480 - protein, 161 aa, Homo sapiens
  Payload ID: 13454
  Gene Symbol: PTGES3L
  Gene Name: prostaglandin E synthase 3 (cytosolic)-like
  ENSP ID: ENSP00000386902
MFSLPLNCSPDHIRRGSCWGRPQDLKIAAPAWNSKCHPGAGAAMARCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 67481 - protein, 128 aa, Homo sapiens
  Payload ID: 13454
  Gene Symbol: PTGES3L
  Gene Name: prostaglandin E synthase 3 (cytosolic)-like
  ENSP ID: ENSP00000401675
  MOD_RES (1)..(1): Any amino acid
XQHARTLWYDRPSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 67482 - protein, 132 aa, Homo sapiens
  Payload ID: 13454
  Gene Symbol: PTGES3L
  Gene Name: prostaglandin E synthase 3 (cytosolic)-like
  ENSP ID: ENSP00000404440
KCHPGAGAAMARQHARTLWYDRPRYVFMEFCVEDSTDVHVLIEDHRIVFSCKNADGVELYNEIEFYAKVNSKPVWLSVDFDNWRDWEGDEEMELAHVEHYAELLKKVSTKRPPPAMDDLDDDSDSADDATSN

SEQ ID NO: 67483 - protein, 164 aa, Homo sapiens
  Payload ID: 13454
  Gene Symbol: PTGES3L
  Gene Name: prostaglandin E synthase 3 (cytosolic)-like
  ENSP ID: ENSP00000467778
  MOD_RES (1)..(1): Any amino acid
XHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 67484 - protein, 297 aa, Homo sapiens
  Payload ID: 13455
  Gene Symbol: PTGFR
  Gene Name: prostaglandin F receptor (FP)
  Uniprot ID: P43088
  ENSP ID: ENSP00000359792
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLGYRIILNGKEKYKVYEEQSDFLHRLQWPTLE

SEQ ID NO: 67485 - protein, 359 aa, Homo sapiens
  Payload ID: 13455
  Gene Symbol: PTGFR
  Gene Name: prostaglandin F receptor (FP)
  Uniprot ID: P43088
  ENSP ID: ENSP00000359793
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 67486 - protein, 359 aa, Homo sapiens; identical to SEQ ID NO: 67485
  Payload ID: 13455
  Gene Symbol: PTGFR
  Gene Name: prostaglandin F receptor (FP)
  Uniprot ID: P43088
  ENSP ID: ENSP00000359794

SEQ ID NO: 67487 - protein, 297 aa, Homo sapiens
  Payload ID: 13455
  Gene Symbol: PTGFR
  Gene Name: prostaglandin F receptor (FP)
  ENSP ID: ENSP00000432599
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLGYRIILNGKEKYKVYEEQSDFLHSDKTLNEK

SEQ ID NO: 67488 - protein, 879 aa, Homo sapiens
  Payload ID: 13456
  Gene Symbol: PTGFRN
  Gene Name: prostaglandin F2 receptor inhibitor
  Uniprot ID: Q9P2B2
  ENSP ID: ENSP00000376899
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 67489 - protein, 386 aa, Homo sapiens [sequence omitted]

SEQ ID NO: 67490 - protein, 296 aa, Homo sapiens
  Payload ID: 13457
  Gene Symbol: PTGIR
  Gene Name: prostaglandin I2 (prostacyclin) receptor (IP)
  ENSP ID: ENSP00000468970
MADSCRNLTYVRGSVGPATSTLMFVAGVVGNGLALGILSARRPARPSAFAVLVTGLAATDLLGTSFLSPAVFVAYARNSSLLGLARGGPALCDAFAFAMTFFGLASMLILFAMAVERCLALSHPYLYAQLDGPRCARLALPAIYAFCVLFCALPLLGLGQHQQYCPGSWCFLRMRWAQPGGAAFSLAYAGLVALLVAAIFLCNGSVTLSLCRMYRQQKRHQGSLGPRPRTGEDEVDHLILLALMTVVMAVCSLPLTHVERPRQDRMRWLTPVIPALWEAEAGGSFEVRSSRPVWPT

SEQ ID NO: 67491 - protein, 143 aa, Homo sapiens
  Payload ID: 13457
  Gene Symbol: PTGIR
  Gene Name: prostaglandin I2 (prostacyclin) receptor (IP)
  ENSP ID: ENSP00000469408
MTVVMAVCSLPLTIRCFTQAVAPDSSSEMGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 67492 - protein, 115 aa, Homo sapiens
  Payload ID: 13457
  Gene Symbol: PTGIR
  Gene Name: prostaglandin I2 (prostacyclin) receptor (IP)
  ENSP ID: ENSP00000470566
MGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 67493 - protein, 174 aa, Homo sapiens
  Payload ID: 13457
  Gene Symbol: PTGIR
  Gene Name: prostaglandin I2 (prostacyclin) receptor (IP)
  ENSP ID: ENSP00000470799
MYRQQKRHQGSLGPRPRTGEDEVDHLILLALMTVVMAVCSLPLTIRCFTQAVAPDSSSEMGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 67494 - protein, 500 aa, Homo sapiens
  Payload ID: 13458
  Gene Symbol: PTGIS
  Gene Name: prostaglandin I2 (prostacyclin) synthase
  Uniprot ID: Q16647
  ENSP ID: ENSP00000244043
MAWAALLGLLAALLLLLLLSRRRTRRPGEPPLDLGSIPWLGYALDFGKDAASFLTRMKEKHGDIFTILVGGRYVTVLLDPHSYDAVVWEPRTRLDFHAYAIFLMERIFDVQLPHYSPSDEKARMKLTLLHRELQALTEAMYTNLHAVLLGDATEAGSGWHEMGLLDFSYSFLLRAGYLTLYGIEALPRTHESQAQDRVHSADVFHTFRQLDRLLPKLARGSLSVGDKDHMCSVKSRLWKLLSPARLARRAHRSKWLESYLLHLEEMGVSEEMQARALVLQLWATQGNMGPAAFWLLLFLLKNPEALAAVRGELESILWQAEQPVSQTTTLPQKVLDSTPVLDSVLSESLRLTAAPFITREVVVDLAMPMADGREFNLRRGDRLLLFPFLSPQRDPEIYTDPEVFKYNRFLNPDGSEKKDFYKDGKRLKNYNMPWGAGHNHCLGRSYAVNSIKQFVFLVLVHLDLELINADVEIPEFDLSRYGFGLMQPEHDVPVRYRIRP

SEQ ID NO: 67495 - protein, 329 aa, Homo sapiens
  Payload ID: 13459
  Gene Symbol: PTGR1
  Gene Name: prostaglandin reductase 1
  Uniprot ID: Q14914
  ENSP ID: ENSP00000311572
MVRTKTWTLKKHFVGYPTNSDFELKTAELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEGKIQYKEYIIEGFENMPAAFMGMLKGDNLGKTIVKA

SEQ ID NO: 67496 - protein, 73 aa, Homo sapiens
  Payload ID: 13459
  Gene Symbol: PTGR1
  Gene Name: prostaglandin reductase 1
  ENSP ID: ENSP00000363444
MVRTKTWTLKKHFVGYPTNSDFELKTAELPPLKNGEVLLEALFLTVDPYMRVAAKRLKEGDTMMGQQVANQLL

SEQ ID NO: 67497 - protein, 329 aa, Homo sapiens; identical to SEQ ID NO: 67495
  Payload ID: 13459
  Gene Symbol: PTGR1
  Gene Name: prostaglandin reductase 1
  Uniprot ID: Q14914
  ENSP ID: ENSP00000385763

SEQ ID NO: 67498 - protein, 119 aa, Homo sapiens
  Payload ID: 13459
  Gene Symbol: PTGR1
  Gene Name: prostaglandin reductase 1
  ENSP ID: ENSP00000395965
MVRTKTWTLKKHFVGYPTNSDFELKTAELPPLKNGEVLLEALFLTVDPYMRVVESKNVALPKGTIVLASPGWTTHSISDGKDLEKLLTEWPDTIPLSLALGTVGMPGLTAYFGLLEICG

SEQ ID NO: 67499 - protein, 118 aa, Homo sapiens
  Payload ID: 13459
  Gene Symbol: PTGR1
  Gene Name: prostaglandin reductase 1
  ENSP ID: ENSP00000435665
QKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLELPYFVID

SEQ ID NO: 67500 - protein, 301 aa, Homo sapiens
  Payload ID: 13459
  Gene Symbol: PTGR1
  Gene Name: prostaglandin reductase 1
  Uniprot ID: Q14914
  ENSP ID: ENSP00000440281
MVRTKTWTLKKHFVGYPTNSDFELKTAELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEIKRENEED

SEQ ID NO: 67501 - protein, 351 aa, Homo sapiens
  Payload ID: 13460
  Gene Symbol: PTGR2
  Gene Name: prostaglandin reductase 2
  Uniprot ID: Q8N8N7
  ENSP ID: ENSP00000267568
MIVQRVVLNSRPGKNGNPVAENFRMEEVYLPDNINEGQVQVRTLYLSVDPYMRCRMNEDTGTDYITPWQLSQVVDGGGIGIIEESKHTNLTKGDFVTSFYWPWQTKVILDGNSLEKVDPQLVDGHLSYFLGAIGMPGLTSLIGIQEKGHITAGSNKTMVVSGAAGACGSVAGQIGHFLGCSRVVGICGTHEKCILLTSELGFDAAINYKKDNVAEQLRESCPAGVDVYFDNVGGNISDTVISQMNENSHIILCGQISQYNKDVPYPPPLSPAIEAIQKERNITRERFLVLNYKDKFEPGILQLSQWFKEGKLKIKETVINGLENMGAAFQSMMTGGNIGKQIVCISEEISL

SEQ ID NO: 67502 - protein, 217 aa, Homo sapiens
  Payload ID: 13460
  Gene Symbol: PTGR2
  Gene Name: prostaglandin reductase 2
  ENSP ID: ENSP00000450824
MPGLTSLIGIQEKGHITAGSNKTMVVSGAAGACGSVAGQIGHFLGCSRVVGICGTHEKCILLTSELGFDAAINYKKDNVAEQLRESCPAGVDVYFDNVGGNISDTVISQMNENSHIILCGQISQYNKDVPYPPPLSPAIEAIQKERNITRERFLVLNYKDKFEPGILQLSQWFKEGKLKIKETVINGLENMGAAFQSMMTGGNIGKQIVCISEEISL

SEQ ID NO: 67503 - protein, 351 aa, Homo sapiens; identical to SEQ ID NO: 67501
  Payload ID: 13460
  Gene Symbol: PTGR2
  Gene Name: prostaglandin reductase 2
  Uniprot ID: Q8N8N7
  ENSP ID: ENSP00000450975

SEQ ID NO: 67504 - protein, 351 aa, Homo sapiens; identical to SEQ ID NO: 67501
  Payload ID: 13460
  Gene Symbol: PTGR2
  Gene Name: prostaglandin reductase 2
  Uniprot ID: Q8N8N7
  ENSP ID: ENSP00000452280

SEQ ID NO: 67505 - protein, 562 aa, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENSP ID: ENSP00000223423
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67506 - protein, 599 aa, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENSP ID: ENSP00000354612
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67507 - protein, 490 aa, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENSP ID: ENSP00000362802
MLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67508 - protein, 156 aa, Homo sapiens
  Payload ID: 13461
  Gene Symbol: PTGS1
  Gene Name: prostaglandin-endoperoxide synthase 1 (prostaglandin G/H synthase and cyclooxygenase)
  ENSP ID: ENSP00000411606
SLLLWFLLFLLLLPPLPVLLADPGAPTPAGLWTWLRNSLRPSPSFTHFLLTHGRWFWEFVNATFIREMLMRLVLTVRSNLIPSPPTYNSAHDYISWESFSNFFKTSGKMGPGFTKALGHGVDLGHIYGDNLERQYQLRLFKDGKLKYQVLDGEMYP

SEQ ID NO: 67509 - protein, 537 aa, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENSP ID: ENSP00000437709
MRKPRLMNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67510 - protein, 630 aa, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENSP ID: ENSP00000483540
MSRECDPGARWGIFLASWWSLECQLSPSSLSSAGSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67511 - protein, 551 aa, Homo sapiens
  Payload ID: 13461
  Gene Symbol: PTGS1
  Gene Name: prostaglandin-endoperoxide synthase 1 (prostaglandin G/H synthase and cyclooxygenase)
  ENSP ID: ENSP00000484800
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 67512 - protein, 604 aa, Homo sapiens
  Payload ID: 13462
  Gene Symbol: PTGS2
  Gene Name: prostaglandin-endoperoxide synthase 2 (prostaglandin G/H synthase and cyclooxygenase)
  Uniprot ID: P35354
  ENSP ID: ENSP00000356438
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 67513 - protein, 163 aa, Homo sapiens
  Payload ID: 13462
  Gene Symbol: PTGS2
  Gene Name: prostaglandin-endoperoxide synthase 2 (prostaglandin G/H synthase and cyclooxygenase)
  ENSP ID: ENSP00000454130
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKALHASVFQDRS

SEQ ID NO: 67514 - protein, 135 aa, Homo sapiens
  Payload ID: 13463
  Gene Symbol: PBOV1
  Gene Name: prostate and breast cancer overexpressed 1
  Uniprot ID: Q9GZY1
  ENSP ID: ENSP00000432353
MRAFLRNQKYEDMHNIIHILQIRKLRHRLSNFPRLPGILAPETVLLPFCYKVFRKKEKVKRSQKATEFIDYSIEQSHHAILTPLQTHLTMKGSSMKCSSLSSEAILFTLTLQLTQTLGLECCLLYLSKTIHPQII

SEQ ID NO: 67515 - protein, 126 aa, Homo sapiens
  Payload ID: 13464
  Gene Symbol: PATE1
  Gene Name: prostate and testis expressed 1
  Uniprot ID: Q8WXA2
  ENSP ID: ENSP00000307164
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 67516 - protein, 114 aa, Homo sapiens
  Payload ID: 13464
  Gene Symbol: PATE1
  Gene Name: prostate and testis expressed 1
  Uniprot ID: Q8WXA2
  ENSP ID: ENSP00000396056
MDKSLLLELPILLCCFRALSGSLSMRNDAVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 67517 - protein, 113 aa, Homo sapiens
  Payload ID: 13465
  Gene Symbol: PATE2
  Gene Name: prostate and testis expressed 2
  Uniprot ID: Q6UY27
  ENSP ID: ENSP00000351325
MLVLFLLGTVFLLCPYWGELHDPIKATEIMCYECKKYHLGLCYGVMTSCSLKHKQSCAVENFYILTRKGQSMYHYSKLSCMTSCEDINFLGFTKRVELICCDHSNYCNLPEGV

SEQ ID NO: 67518 - protein, 70 aa, Homo sapiens
  Payload ID: 13465
  Gene Symbol: PATE2
  Gene Name: prostate and testis expressed 2
  Uniprot ID: Q6UY27
  ENSP ID: ENSP00000414895
MLVLFLLGTVFLLCPYWGELHDPIKGQSMYHYSKLSCMTSCEDINFLGFTKRVELICCDHSNYCNLPEGV

SEQ ID NO: 67519 - protein, 98 aa, Homo sapiens
  Payload ID: 13466
  Gene Symbol: PATE3
  Gene Name: prostate and testis expressed 3
  Uniprot ID: B3GLJ2
  ENSP ID: ENSP00000395505
MNKHFLFLFLLYCLIVAVTSLQCITCHLRTRTDRCRRGFGVCTAQKGEACMLLRIYQRNTLQISYMVCQKFCRDMTFDLRNRTYVHTCCNYNYCNFKL

SEQ ID NO: 67520 - protein, 98 aa, Homo sapiens
  Payload ID: 13467
  Gene Symbol: PATE4
  Gene Name: prostate and testis expressed 4
  Uniprot ID: P0C8F1
  ENSP ID: ENSP00000411439
MRKMNTLLLVSLSFLYLKEVMGLKCNTCIYTEGWKCMAGRGTCIAKENELCSTTAYFRGDKHMYSTHMCKYKCREEESSKRGLLRVTLCCDRNFCNVF

SEQ ID NO: 67521 - protein, 59 aa, Homo sapiens
  Payload ID: 13467
  Gene Symbol: PATE4
  Gene Name: prostate and testis expressed 4
  ENSP ID: ENSP00000435472
MRKMNTLLLVSLSFLYLKEGDKHMYSTHMCKYKCREEESSKRGLLRVTLCCDRNFCNVF

SEQ ID NO: 67522 - protein, 310 aa, Homo sapiens
  Payload ID: 13468
  Gene Symbol: PARM1
  Gene Name: prostate androgen-regulated mucin-like protein 1
  Uniprot ID: Q6UWI2
  ENSP ID: ENSP00000370224
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 67523 - protein, 68 aa, Homo sapiens
  Payload ID: 13468
  Gene Symbol: PARM1
  Gene Name: prostate androgen-regulated mucin-like protein 1
  ENSP ID: ENSP00000424276
MVYKTLFALCILTAGSIAAITVTVIAVVLLVFGVAAYLKIRHSSYGRLLDDHDYGSWGNYNNPLYDDS

SEQ ID NO: 67524 - protein, 57 aa, Homo sapiens
  Payload ID: 13469
  Gene Symbol: PRAC1
  Gene Name: prostate cancer susceptibility candidate 1
  Uniprot ID: Q96KF2
  ENSP ID: ENSP00000290294
MLCAHFSDQGPAHLTTSKSAFLSNKKTSTLKHLLGETRSDGSACNSGISGGRGRKIP

SEQ ID NO: 67525 - protein, 90 aa, Homo sapiens
  Payload ID: 13470
  Gene Symbol: PRAC2
  Gene Name: prostate cancer susceptibility candidate 2
  Uniprot ID: D3DTV9
  ENSP ID: ENSP00000481367
MDRRRMALRPGSRRPTAFFFHSRWLVPNLLAFFLGLSGAGPIHLPMPWPNGRRHRVLDPHTQLSTHEAPGRWKPVAPRTMKACPQVLLEW

SEQ ID NO: 67526 - protein, 140 aa, Homo sapiens
  Payload ID: 13470
  Gene Symbol: PRAC2
  Gene Name: prostate cancer susceptibility candidate 2
  ENSP ID: ENSP00000484945
MEPQVRALRCGCWNRDSKRASGGSIQVNPKKSVCGGVHTTNYYGEEDKEDMDRRRMALRPGSRRPTAFFFHSRWLVPNLLAFFLGLSGAGPIHLPMPWPNGRRHRVLDPHTQLSTHEAPGRWKPVAPRTMKACPQVLLEW

SEQ ID NO: 67527 - protein, 114 aa, Homo sapiens
  Payload ID: 13471
  Gene Symbol: PSCA
  Gene Name: prostate stem cell antigen
  Uniprot ID: O43653
  ENSP ID: ENSP00000301258
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 67528 - protein, 54 aa, Homo sapiens
  Payload ID: 13471
  Gene Symbol: PSCA
  Gene Name: prostate stem cell antigen
  ENSP ID: ENSP00000426508
MAGLALQPGTALLCYSCKAQVSNEDCLQVENCTQLGEQCWTARIREWGDDSRQA

SEQ ID NO: 67529 - protein, 237 aa, Homo sapiens
  Payload ID: 13472
  Gene Symbol: PMEPA1
  Gene Name: prostate transmembrane protein, androgen induced 1
  Uniprot ID: Q969W9
  ENSP ID: ENSP00000265626
MMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 67530 - protein, 252 aa, Homo sapiens
  Payload ID: 13472
  Gene Symbol: PMEPA1
  Gene Name: prostate transmembrane protein, androgen induced 1
  Uniprot ID: Q969W9
  ENSP ID: ENSP00000344014
MAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 67531 - protein, 287 aa, Homo sapiens
  Payload ID: 13472
  Gene Symbol: PMEPA1
  Gene Name: prostate transmembrane protein, androgen induced 1
  Uniprot ID: Q969W9
  ENSP ID: ENSP00000345826
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 67532 - protein, 237 aa, Homo sapiens; identical to SEQ ID NO: 67529
  Payload ID: 13472
  Gene Symbol: PMEPA1
  Gene Name: prostate transmembrane protein, androgen induced 1
  Uniprot ID: Q969W9
  ENSP ID: ENSP00000379159

SEQ ID NO: 67533 - protein, 237 aa, Homo sapiens; identical to SEQ ID NO: 67529
  Payload ID: 13472
  Gene Symbol: PMEPA1
  Gene Name: prostate transmembrane protein, androgen induced 1
  Uniprot ID: Q969W9
  ENSP ID: ENSP00000379161

SEQ ID NO: 67534 - protein, 227 aa, Homo sapiens
  Payload ID: 13472
  Gene Symbol: PMEPA1
  Gene Name: prostate transmembrane protein, androgen induced 1
  ENSP ID: ENSP00000379164
MHRLMGVNSTAAAAAGQPNVSCTCNCKRSLFQSMEISCHGFPVCKSHQHQEWKSLCWSLRSPGGASSITGFGSMKVTNPAMNLPECQWLRIQKAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLR

SEQ ID NO: 67535 - protein, 208 aa, Homo sapiens
  Payload ID: 13472
  Gene Symbol: PMEPA1
  Gene Name: prostate transmembrane protein, androgen induced 1
  ENSP ID: ENSP00000401506
MPAIPAHGAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVI

SEQ ID NO: 67536 - protein, 416 aa, Homo sapiens
  Payload ID: 13473
  Gene Symbol: PTOV1
  Gene Name: prostate tumor overexpressed 1
  Uniprot ID: Q86YD1
  ENSP ID: ENSP00000375717
MVRPRRAPYRSGAGGPLGGRGRPPRPLVVRAVRSRSWPASPRGPQPPRIRARSAPPMEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 67537 - protein, 42 aa, Homo sapiens
  Payload ID: 13473
  Gene Symbol: PTOV1
  Gene Name: prostate tumor overexpressed 1
  ENSP ID: ENSP00000468905
QVLQRNLEQEQQQRGVRWPASRAAQSPSTPAACSPLASDFSP

SEQ ID NO: 67538 - protein, 416 aa, Homo sapiens; identical to SEQ ID NO: 67536
  Payload ID: 13473
  Gene Symbol: PTOV1
  Gene Name: prostate tumor overexpressed 1
  Uniprot ID: Q86YD1
  ENSP ID: ENSP00000469128

SEQ ID NO: 67539 - protein, 384 aa, Homo sapiens
  Payload ID: 13473
  Gene Symbol: PTOV1
  Gene Name: prostate tumor overexpressed 1
  ENSP ID: ENSP00000469541
MRSPAVPTPARGQLGVAFVLLPPHSEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 67540 - protein, 111 aa, Homo sapiens
  Payload ID: 13473
  Gene Symbol: PTOV1
  Gene Name: prostate tumor overexpressed 1
  ENSP ID: ENSP00000469838
RPEPNSRSKRWLPSHVYVNQGEILRTEQWPRKLYMQLIPQQLLTTLVPLFRNSRLVQFHFTKDLETLKSLCRIMDNGFGNFVNGIRRVIANQQQVLQRNLEQEQQQRGMGG

SEQ ID NO: 67541 - protein, 283 aa, Homo sapiens
  Payload ID: 13473
  Gene Symbol: PTOV1
  Gene Name: prostate tumor overexpressed 1
  ENSP ID: ENSP00000469839
MRSPAVPTPARGQLGVAFVLLPPHSVGAPVPATPPEVVARASSQDSPAPERPAGPPSPHSAPARAPLPRAALEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQE

SEQ ID NO: 67542 - protein, 237 aa, Homo sapiens
  Payload ID: 13473
  Gene Symbol: PTOV1
  Gene Name: prostate tumor overexpressed 1
  ENSP ID: ENSP00000470007
MRSPAVPTPARGQLGVAFVLLPPHSEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEA

SEQ ID NO: 67543 - protein, 142 aa, Homo sapiens
  Payload ID: 13473
  Gene Symbol: PTOV1
  Gene Name: prostate tumor overexpressed 1
  ENSP ID: ENSP00000470439
EGARVFGALGPIGPSSPGLTLGGLAVSEHRLSNKLLAWSGVLEWQEKRRPYSDSTAKLKRTLPCQAYVNQGENLETDQWPQKLIMQLIPQQLLAGCMLFPHISPCEVRVLMLLYSSKKKIFMGLIPYDQSGFVSAIRQVITT

SEQ ID NO: 67544 - protein, 374 aa, Homo sapiens
  Payload ID: 13473
  Gene Symbol: PTOV1
  Gene Name: prostate tumor overexpressed 1
  ENSP ID: ENSP00000471458
MRSPAVPTPARGQLGVAFVLLPPHSEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFRRKSSLASSPMTRATLSTASGVSLPTSSRSCSGTWSRSNSNEGWGGSGYPGLGPSRSHR

SEQ ID NO: 67545 - protein, 416 aa, Homo sapiens; identical to SEQ ID NO: 67536
  Payload ID: 13473
  Gene Symbol: PTOV1
  Gene Name: prostate tumor overexpressed 1
  Uniprot ID: Q86YD1
  ENSP ID: ENSP00000472816

SEQ ID NO: 67546 - protein, 51 aa, Homo sapiens
  Payload ID: 13474
  Gene Symbol: PRM1
  Gene Name: protamine 1
  Uniprot ID: P04553
  ENSP ID: ENSP00000310515
MARYRCCRSQSRSRYYRQRQRSRRRRRRSCQTRRRAMRCCRPRYRPRCRRH

SEQ ID NO: 67547 - protein, 102 aa, Homo sapiens
  Payload ID: 13475
  Gene Symbol: PRM2
  Gene Name: protamine 2
  Uniprot ID: P04554
  ENSP ID: ENSP00000241808
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 67548 - protein, 140 aa, Homo sapiens
  Payload ID: 13475
  Gene Symbol: PRM2
  Gene Name: protamine 2
  Uniprot ID: P04554
  ENSP ID: ENSP00000403681
MVRYRVRSLSERSHEVYRQQLHGQEQGHHGQEEQGLSPEHVEVYERTHGQSHYRRRHCSRRRLHRIHRRQHRSCRRRKRRSCRHRRRHRRESLGDPLNQNFLSQKAAEPGREHAEGTKLPGPLTPSWKLRKSRPKHQVRP

SEQ ID NO: 67549 - protein, 103 aa, Homo sapiens
  Payload ID: 13476
  Gene Symbol: PRM3
  Gene Name: protamine 3
  Uniprot ID: Q9NNZ6
  ENSP ID: ENSP00000325638
MGSRCAKLNTGQSPGHSPGHSTGHGRGHESSMKKLMACVSQDNFSLSSAGEEEEEEEEEGEEEEKEELPVQGKLLLLEPERQEEGHKDNAEAQQSPEPKRTPS

SEQ ID NO: 67550 - protein, 311 aa, Homo sapiens
  Payload ID: 13477
  Gene Symbol: PRSS22
  Gene Name: Protease, serine 22
  ENSP ID: ENSP00000489190
VGALGLRDLRVSLGTGGLEVPHHQKGAGVRGACGKPQQLNRVVGGEDSTDSEWPWIVSIQKNGTHHCAGSLLTSRWVITAAHCFKEYVNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 67551 - protein, 324 aa, Homo sapiens
  Payload ID: 13477
  Gene Symbol: PRSS22
  Gene Name: Protease, serine 22
  ENSP ID: ENSP00000489375
WAVGKAWGAGLGIGIPGVGCRKLEIPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWALPHCSVPPGQPSPAPRLPLFPLLSLLLSCFSSLSTLILRPSVLWVPVPLPH

SEQ ID NO: 67552 - protein, 317 aa, Homo sapiens
  Payload ID: 13477
  Gene Symbol: PRSS22
  Gene Name: Protease, serine 22
  ENSP ID: ENSP00000489576
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 67553 - protein, 290 aa, Homo sapiens
  Payload ID: 13478
  Gene Symbol: PRSS27
  Gene Name: protease, serine 27
  Uniprot ID: Q9BQR3
  ENSP ID: ENSP00000306390
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 67554 - protein, 40 aa, Homo sapiens
  Payload ID: 13478
  Gene Symbol: PRSS27
  Gene Name: protease, serine 27
  ENSP ID: ENSP00000455636
MRRPAAVPLLLLLCFGSQRAKAATAPLRRPCTRSCWGQGS

SEQ ID NO: 67555 - protein, 40 aa, Homo sapiens; identical to SEQ ID NO: 67554
  Payload ID: 13478
  Gene Symbol: PRSS27
  Gene Name: protease, serine 27
  ENSP ID: ENSP00000456886

SEQ ID NO: 67556 - protein, 247 aa, Homo sapiens
  Payload ID: 13479
  Gene Symbol: PRSS1
  Gene Name: protease, serine, 1 (trypsin 1)
  Uniprot ID: P07477
  ENSP ID: ENSP00000308720
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 67557 - protein, 261 aa, Homo sapiens
  Payload ID: 13479
  Gene Symbol: PRSS1
  Gene Name: protease, serine, 1 (trypsin 1)
  ENSP ID: ENSP00000417854
MNPLLILTFVAAALAAPFDDDDKIVGGYNCEENSVPYQVSLNSGYHFCGGSLINEQWVVSAGHCYKSAIKSKFSGRGCEYHRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 67558 - protein, 142 aa, Homo sapiens
  Payload ID: 13479
  Gene Symbol: PRSS1
  Gene Name: protease, serine, 1 (trypsin 1)
  ENSP ID: ENSP00000419912
SLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGG

SEQ ID NO: 67559 - protein, 237 aa, Homo sapiens
  Payload ID: 13479
  Gene Symbol: PRSS1
  Gene Name: protease, serine, 1 (trypsin 1)
  ENSP ID: ENSP00000478237
MNPLLILTFVAAALAAPFDDDDKIVGGYNCEENSVPYQVSLNSGYHFCGGSLINEQWVVSAGHCYKSRIQVRLGEHNINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 67560 - protein, 247 aa, Homo sapiens; identical to SEQ ID NO: 67556
  Payload ID: 13479
  Gene Symbol: PRSS1
  Gene Name: protease, serine, 1 (trypsin 1)
  Uniprot ID: P07477
  ENSP ID: ENSP00000479217

SEQ ID NO: 67561 - protein, 247 aa, Homo sapiens
  Payload ID: 13479
  Gene Symbol: PRSS1
  Gene Name: protease, serine, 1 (trypsin 1)
  ENSP ID: ENSP00000479959
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGYGCAQKNRPGVYTKVYNYVDWIKDTIAANS

SEQ ID NO: 67562 - protein, 237 aa, Homo sapiens; identical to SEQ ID NO: 67559
  Payload ID: 13479
  Gene Symbol: PRSS1
  Gene Name: protease, serine, 1 (trypsin 1)
  ENSP ID: ENSP00000481361

SEQ ID NO: 67563 - protein, 261 aa, Homo sapiens; identical to SEQ ID NO: 67557
  Payload ID: 13479
  Gene Symbol: PRSS1
  Gene Name: protease, serine, 1 (trypsin 1)
  ENSP ID: ENSP00000487956

SEQ ID NO: 67564 - protein, 142 aa, Homo sapiens; identical to SEQ ID NO: 67558
  Payload ID: 13479
  Gene Symbol: PRSS1
  Gene Name: protease, serine, 1 (trypsin 1)
  ENSP ID: ENSP00000488689

SEQ ID NO: 67565 - protein, 875 aa, Homo sapiens
  Payload ID: 13480
  Gene Symbol: PRSS12
  Gene Name: protease, serine, 12 (neurotrypsin, motopsin)
  Uniprot ID: P56730
  ENSP ID: ENSP00000296498
MTLARFVLALMLGALPEVVGFDSVLNDSLHHSHRHSPPAGPHYPYYLPTQQRPPRTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 67566 - protein, 514 aa, Homo sapiens
  Payload ID: 13481
  Gene Symbol: PRSS16
  Gene Name: protease, serine, 16 (thymus)
  Uniprot ID: Q9NQE7
  ENSP ID: ENSP00000230582
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 67567 - protein, 145 aa, Homo sapiens
  Payload ID: 13481
  Gene Symbol: PRSS16
  Gene Name: protease, serine, 16 (thymus)
  ENSP ID: ENSP00000396589
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRDCLAQPGPEVFKLFPSRDSGTAEEHRTSTVWCG

SEQ ID NO: 67568 - protein, 257 aa, Homo sapiens
  Payload ID: 13481
  Gene Symbol: PRSS16
  Gene Name: protease, serine, 16 (thymus)
  ENSP ID: ENSP00000404349
MAVWLAQWLGPLLLVSLWGLLAPASLLRRLGEHIQQFQESSAQGLGLSLGPGAAALPKVGWLEQLLDPFNVSDRRSFLQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 67569 - protein, 92 aa, Homo sapiens
  Payload ID: 13481
  Gene Symbol: PRSS16
  Gene Name: protease, serine, 16 (thymus)
  ENSP ID: ENSP00000418036
MAVWLAQWLGPLLLVSLWGLLAPASLLRRLGEHIQQFQESSAQGLGLSLGPGAAALPKVGWLEQLLDPFNVSDRRSFLQAIPQPWPQPGAPW

SEQ ID NO: 67570 - protein, 138 aa, Homo sapiens
  Payload ID: 13481
  Gene Symbol: PRSS16
  Gene Name: protease, serine, 16 (thymus)
  ENSP ID: ENSP00000418710
  MOD_RES (1)..(1): Any amino acid
XVMRGHPAALAPAWGALVISLEHRFYGLSIPAGGLEMAQLRFLSSRLALADVVSARLALSRLFNISSSSPWICFGGSYAGSLAAWARLKIVLHSLGQKCLSFSRAETVAQLRSTEPQLSGVGDRQWLYQTCTEFGFYV

SEQ ID NO: 67571 - protein, 99 aa, Homo sapiens
  Payload ID: 13481
  Gene Symbol: PRSS16
  Gene Name: protease, serine, 16 (thymus)
  ENSP ID: ENSP00000419437
MAVWLAQWLGPLLLVSLWGLLAPASLLRRLGEHIQQFQESSAQGLGLSLGPGAAALPKVGWLEQLLDPFNVSDRRSFLQMSPVRIPDVLSPSSQHCPPS

SEQ ID NO: 67572 - protein, 166 aa, Homo sapiens
  Payload ID: 13481
  Gene Symbol: PRSS16
  Gene Name: protease, serine, 16 (thymus)
  ENSP ID: ENSP00000419492
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALSCTAWARSV

SEQ ID NO: 67573 - protein, 164 aa, Homo sapiens
  Payload ID: 13481
  Gene Symbol: PRSS16
  Gene Name: protease, serine, 16 (thymus)
  ENSP ID: ENSP00000419538
  MOD_RES (1)..(1): Any amino acid
XVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDIVLHSLGQKCLSFSRAETVAQLRSTEPQLSGVGDRQWLYQTCTEFGFYV

SEQ ID NO: 67574 - protein, 249 aa, Homo sapiens
  Payload ID: 13482
  Gene Symbol: PRSS2
  Gene Name: protease, serine, 2 (trypsin 2)
  ENSP ID: ENSP00000487822
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67575 - protein, 247 aa, Homo sapiens
  Payload ID: 13482
  Gene Symbol: PRSS2
  Gene Name: protease, serine, 2 (trypsin 2)
  Uniprot ID: P07478
  ENSP ID: ENSP00000487952
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67576 - protein, 246 aa, Homo sapiens
  Payload ID: 13482
  Gene Symbol: PRSS2
  Gene Name: protease, serine, 2 (trypsin 2)
  ENSP ID: ENSP00000488077
MNLLLILTFVAAAVAAPFDDDDKIVGGYICEENSVPYQVSLNSGYHFCGGSLISEQWVVSAGHCYKSAINSKLSGRGCEYHRIQVRLGEHNIEVLEGNEQFINAAKIIRHPKYNSRTLDNDILLIKLSSPAVINSRESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67577 - protein, 247 aa, Homo sapiens; identical to SEQ ID NO: 67575
  Payload ID: 13482
  Gene Symbol: PRSS2
  Gene Name: protease, serine, 2 (trypsin 2)
  Uniprot ID: P07478
  ENSP ID: ENSP00000488338

SEQ ID NO: 67578 - protein, 261 aa, Homo sapiens
  Payload ID: 13482
  Gene Symbol: PRSS2
  Gene Name: protease, serine, 2 (trypsin 2)
  ENSP ID: ENSP00000488437
MNLLLILTFVAAAVAAPFDDDDKIVGGYICEENSVPYQVSLNSGYHFCGGSLISEQWVVSAGHCYKSAINSKLSGRGCEYHRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67579 - protein, 261 aa, Homo sapiens
  Payload ID: 13482
  Gene Symbol: PRSS2
  Gene Name: protease, serine, 2 (trypsin 2)
  ENSP ID: ENSP00000488594
MHMRETNVFTLKKGRSAPLVFHPPEALIAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67580 - protein, 247 aa, Homo sapiens
  Payload ID: 13482
  Gene Symbol: PRSS2
  Gene Name: protease, serine, 2 (trypsin 2)
  ENSP ID: ENSP00000488789
MNPLLILAFVGAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 67581 - protein, 314 aa, Homo sapiens
  Payload ID: 13483
  Gene Symbol: PRSS21
  Gene Name: protease, serine, 21 (testisin)
  Uniprot ID: Q9Y6M0
  ENSP ID: ENSP00000005995
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 67582 - protein, 300 aa, Homo sapiens
  Payload ID: 13483
  Gene Symbol: PRSS21
  Gene Name: protease, serine, 21 (testisin)
  Uniprot ID: Q9Y6M0
  ENSP ID: ENSP00000407741
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 67583 - protein, 218 aa, Homo sapiens
  Payload ID: 13483
  Gene Symbol: PRSS21
  Gene Name: protease, serine, 21 (testisin)
  ENSP ID: ENSP00000458341
  MOD_RES (1)..(1): Any amino acid
XLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHGLCWQCPRREGCLLR

SEQ ID NO: 67584 - protein, 81 aa, Homo sapiens
  Payload ID: 13483
  Gene Symbol: PRSS21
  Gene Name: protease, serine, 21 (testisin)
  ENSP ID: ENSP00000459664
  MOD_RES (1)..(1): Any amino acid
XRGAAAGAAAGSGWTQEAGVAGGGAVIRTMRPTGHHVAHRGWRGRRTRALAVAGEPAPVGFPRMRSEPAQPPLGTHGGALL

SEQ ID NO: 67585 - protein, 256 aa, Homo sapiens
  Payload ID: 13483
  Gene Symbol: PRSS21
  Gene Name: protease, serine, 21 (testisin)
  ENSP ID: ENSP00000460351
  MOD_RES (1)..(1): Any amino acid
XSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 67586 - protein, 81 aa, Homo sapiens
  Payload ID: 13483
  Gene Symbol: PRSS21
  Gene Name: protease, serine, 21 (testisin)
  ENSP ID: ENSP00000460417
ARGAAAGAAAGSGWTQEAGVAGGGAVIRTMRPTGHHVAHRGWRGRRTRALAVAGEPAPVGFPRMRSEPAQPPLGTHGGALL

SEQ ID NO: 67587 - protein, 300 aa, Homo sapiens; identical to SEQ ID NO: 67582
  Payload ID: 13483
  Gene Symbol: PRSS21
  Gene Name: protease, serine, 21 (testisin)
  ENSP ID: ENSP00000489081

SEQ ID NO: 67588 - protein, 218 aa, Homo sapiens; identical to SEQ ID NO: 67583
  Payload ID: 13483
  Gene Symbol: PRSS21
  Gene Name: protease, serine, 21 (testisin)
  ENSP ID: ENSP00000489314
  MOD_RES (1)..(1): Any amino acid

SEQ ID NO: 67589 - protein, 314 aa, Homo sapiens; identical to SEQ ID NO: 67581
  Payload ID: 13483
  Gene Symbol: PRSS21
  Gene Name: protease, serine, 21 (testisin)
  ENSP ID: ENSP00000489315

SEQ ID NO: 67590 - protein, 81 aa, Homo sapiens; identical to SEQ ID NO: 67586
  Payload ID: 13483
  Gene Symbol: PRSS21
  Gene Name: protease, serine, 21 (testisin)
  ENSP ID: ENSP00000489355

SEQ ID NO: 67591 - protein, 81 aa, Homo sapiens; identical to SEQ ID NO: 67584
  Payload ID: 13483
  Gene Symbol: PRSS21
  Gene Name: protease, serine, 21 (testisin)
  ENSP ID: ENSP00000489376
  MOD_RES (1)..(1): Any amino acid

SEQ ID NO: 67592 - protein, 256 aa, Homo sapiens; identical to SEQ ID NO: 67585
  Payload ID: 13483
  Gene Symbol: PRSS21
  Gene Name: protease, serine, 21 (testisin)
  ENSP ID: ENSP00000489492
  MOD_RES (1)..(1): Any amino acid

SEQ ID NO: 67593 - protein, 317 aa, Homo sapiens; identical to SEQ ID NO: 67552
  Payload ID: 13484
  Gene Symbol: PRSS22
  Gene Name: protease, serine, 22
  Uniprot ID: Q9GZN4
  ENSP ID: ENSP00000161006

SEQ ID NO: 67594 - protein, 207 aa, Homo sapiens
  Payload ID: 13484
  Gene Symbol: PRSS22
  Gene Name: protease, serine, 22
  ENSP ID: ENSP00000458506
MVVSGAPPALGGGCLGTFTSLLLLASTAILNAARIPVPPACGKPQQLNRVVGGEDSTDSEWPWIVSIQKNGTHHCAVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 67595 - protein, 116 aa, Homo sapiens
  Payload ID: 13484
  Gene Symbol: PRSS22
  Gene Name: protease, serine, 22
  ENSP ID: ENSP00000458562
  MOD_RES (1)..(1): Any amino acid
XLLSASALFISCSLTALCLGFFYGCEDETENAASTQRASVSSYRRRRHRLLPLASVFSHLLVLRCLPLGKHRFVLFLPQEVRGGHTSGSSVQSRGAQPSSMRPGYLFPQPVGSPSS

SEQ ID NO: 67596 - protein, 383 aa, Homo sapiens
  Payload ID: 13485
  Gene Symbol: PRSS23
  Gene Name: protease, serine, 23
  Uniprot ID: O95084
  ENSP ID: ENSP00000280258
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 67597 - protein, 154 aa, Homo sapiens
  Payload ID: 13485
  Gene Symbol: PRSS23
  Gene Name: protease, serine, 23
  ENSP ID: ENSP00000435951
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSV

SEQ ID NO: 67598 - protein, 82 aa, Homo sapiens
  Payload ID: 13485
  Gene Symbol: PRSS23
  Gene Name: protease, serine, 23
  ENSP ID: ENSP00000436676
MSRMRPVCQPWPSPHAPTTVKREGSTVSNSIQPPPPEYQLGSRTWLEAETPGQKRQCSAFMEFTEESRRASHFSSILKIEPV

SEQ ID NO: 67599 - protein, 91 aa, Homo sapiens
  Payload ID: 13485
  Gene Symbol: PRSS23
  Gene Name: protease, serine, 23
  ENSP ID: ENSP00000437268
MSRMRPVCQPWPSPHAPTTVKREGSTVSNSIQPPPPEYQLGSRTWLEAETPGQKRQCSAFMEFTEESRRIHQSVGTLLPRVKSFGRPNPHA

SEQ ID NO: 67600 - protein, 261 aa, Homo sapiens
  Payload ID: 13486
  Gene Symbol: PRSS3
  Gene Name: protease, serine, 3
  Uniprot ID: P35030
  ENSP ID: ENSP00000340889
MHMRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 67601 - protein, 304 aa, Homo sapiens
  Payload ID: 13486
  Gene Symbol: PRSS3
  Gene Name: protease, serine, 3
  Uniprot ID: P35030
  ENSP ID: ENSP00000354280
MCGPDDRCPARWPGPGRAVKCGKGLAAARPGRVERGGAQRGGAGLELHPLLGGRTWRAARDADGCEALGTVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 67602 - protein, 247 aa, Homo sapiens
  Payload ID: 13486
  Gene Symbol: PRSS3
  Gene Name: protease, serine, 3
  Uniprot ID: P35030
  ENSP ID: ENSP00000368715
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 67603 - protein, 177 aa, Homo sapiens
  Payload ID: 13486
  Gene Symbol: PRSS3
  Gene Name: protease, serine, 3
  ENSP ID: ENSP00000401249
MRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPV

SEQ ID NO: 67604 - protein, 240 aa, Homo sapiens
  Payload ID: 13486
  Gene Symbol: PRSS3
  Gene Name: protease, serine, 3
  Uniprot ID: P35030
  ENSP ID: ENSP00000401828
MGPAGEVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 67605 - protein, 280 aa, Homo sapiens
  Payload ID: 13487
  Gene Symbol: PRSS33
  Gene Name: protease, serine, 33
  Uniprot ID: Q8NF86
  ENSP ID: ENSP00000293851
MRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVSF

SEQ ID NO: 67606 - protein, 280 aa, Homo sapiens; identical to SEQ ID NO: 67605
  Payload ID: 13487
  Gene Symbol: PRSS33
  Gene Name: protease, serine, 33
  Uniprot ID: Q8NF86
  ENSP ID: ENSP00000458369

SEQ ID NO: 67607 - protein, 115 aa, Homo sapiens
  Payload ID: 13487
  Gene Symbol: PRSS33
  Gene Name: protease, serine, 33
  ENSP ID: ENSP00000459051
MRGVSCLQVLLLLVLGAAGTQGRKSAACGQPRMSSRIVGGRDGRDGEWPWQASIQHRGAHVCGGSLIAPQWVLTAAHCFPSAPPRVATATRSKGAAAGLAHLRRPLPRGRGRAPG

SEQ ID NO: 67608 - protein, 236 aa, Homo sapiens
  Payload ID: 13487
  Gene Symbol: PRSS33
  Gene Name: protease, serine, 33
  ENSP ID: ENSP00000460368
MRGVSCLQVLLLLVLACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQVCTQPPQPPESPPCAQHPP

SEQ ID NO: 67609 - protein, 284 aa, Homo sapiens
  Payload ID: 13487
  Gene Symbol: PRSS33
  Gene Name: protease, serine, 33
  ENSP ID: ENSP00000483765
MRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVASNASR

SEQ ID NO: 67610 - protein, 413 aa, Homo sapiens
  Payload ID: 13488
  Gene Symbol: PRSS35
  Gene Name: protease, serine, 35
  Uniprot ID: Q8N3Z0
  ENSP ID: ENSP00000358714
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLRERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 67611 - protein, 855 aa, Homo sapiens
  Payload ID: 13489
  Gene Symbol: PRSS36
  Gene Name: protease, serine, 36
  Uniprot ID: Q5K4E3
  ENSP ID: ENSP00000268281
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 67612 - protein, 752 aa, Homo sapiens
  Payload ID: 13489
  Gene Symbol: PRSS36
  Gene Name: protease, serine, 36
  Uniprot ID: Q5K4E3
  ENSP ID: ENSP00000407160
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 67613 - protein, 850 aa, Homo sapiens
  Payload ID: 13489
  Gene Symbol: PRSS36
  Gene Name: protease, serine, 36
  Uniprot ID: Q5K4E3
  ENSP ID: ENSP00000454768
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEENDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 67614 - protein, 28 aa, Homo sapiens
  Payload ID: 13489
  Gene Symbol: PRSS36
  Gene Name: protease, serine, 36
  ENSP ID: ENSP00000460298
  MOD_RES (1)..(1): Any amino acid
XIEVYLGRAGASSLPQGHQSLWLLLSPS

SEQ ID NO: 67615 - protein, 235 aa, Homo sapiens
  Payload ID: 13490
  Gene Symbol: PRSS37
  Gene Name: protease, serine, 37
  Uniprot ID: A4D1T9
  ENSP ID: ENSP00000297767
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLTLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 67616 - protein, 65 aa, Homo sapiens
  Payload ID: 13490
  Gene Symbol: PRSS37
  Gene Name: protease, serine, 37
  ENSP ID: ENSP00000395287
MKYVFYLGVLAERRPCSLFGVPQVSLQPLCGRPHQTQLGAGPSSLLFTKSESDAGKFQEQSQRRY

SEQ ID NO: 67617 - protein, 68 aa, Homo sapiens
  Payload ID: 13490
  Gene Symbol: PRSS37
  Gene Name: protease, serine, 37
  ENSP ID: ENSP00000398810
MKYVFYLGVLAGTFFFADSSVQKEDPAPYLVYLKSHFNPCVGVLIKPSWVLAPAHCYLPMNAFYHLKI

SEQ ID NO: 67618 - protein, 235 aa, Homo sapiens; identical to SEQ ID NO: 67615
  Payload ID: 13490
  Gene Symbol: PRSS37
  Gene Name: protease, serine, 37
  Uniprot ID: A4D1T9
  ENSP ID: ENSP00000414461

SEQ ID NO: 67619 - protein, 326 aa, Homo sapiens
  Payload ID: 13491
  Gene Symbol: PRSS38
  Gene Name: protease, serine, 38
  Uniprot ID: A1L453
  ENSP ID: ENSP00000355719
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 67620 - protein, 100 aa, Homo sapiens
  Payload ID: 13492
  Gene Symbol: PRSS42
  Gene Name: protease, serine, 42
  ENSP ID: ENSP00000401581
MASFLAVVGAPGGVNSCVFDRFHYSVKMGDRSVYNENTSVVVSVQRAFVHPKFSTVTTIRNDLALLQLQHPVNFTSNIQPICIPQENFQVEGRFWGPLGL

SEQ ID NO: 67621 - protein, 293 aa, Homo sapiens
  Payload ID: 13492
  Gene Symbol: PRSS42
  Gene Name: protease, serine, 42
  Uniprot ID: Q7Z5A4
  ENSP ID: ENSP00000401701
MSSGGGSRGLLAWLLLLQPWPGQNWAGMAAPRLPSPLLSEEGGENPEASPAPGPEAGPPLNLFTSFPGDSLLCGRTPLRIVGGVDAEEGRWPWQVSVRTKGRHICGGTLVTATWVLTAGHCISSRFHYSVKMGDRSVYNENTSVVVSVQRAFVHPKFSTVTTIRNDLALLQLQHPVNFTSNIQPICIPQENFQVEGRTRCWVTGWGKTPEREKLASEILQDVDQYIMCYEECNKIIQKALSSTKDVIIKGMVCGYKEQGKDSCQGDSGGRLACEYNDTWVQVGIVSWGIGCGR

SEQ ID NO: 67622 - protein, 228 aa, Homo sapiens
  Payload ID: 13493
  Gene Symbol: PRSS45
  Gene Name: protease, serine, 45
  Uniprot ID: Q7RTY3
  ENSP ID: ENSP00000401932
MTRHWPWEVSLRMENEHVCGGALIDPSWVVTAAHCIQGTKEYSVVLGTSKLQPMNFSRALWVPVRDIIMHPKYWGRAFIMGDVALVHLQTPVTFSSTANSMLTPELQEAEVFIMDNKRCDRHYKKSFFPPVVPLVLGDMICATNYGENLCYGDSGGPLACEVEGRWILAGVLSWEKACVKAQNPGVYTRITKYTKWIKKQMSNGAFSGPCASACLLFLCWLLQPQMGS

SEQ ID NO: 67623 - protein, 110 aa, Homo sapiens
  Payload ID: 13493
  Gene Symbol: PRSS45
  Gene Name: protease, serine, 45
  ENSP ID: ENSP00000429264
MTRHWPWEVSLRMENEHVCGGALIDPSWVVTAAHCIQGTKEYSVVLGTSKLQPMNFSRALWVPVRDIIMHPKYWGRAFIMGDVALVHLQTPVTFSELHSQLHADPRAAGG

SEQ ID NO: 67624 - protein, 260 aa, Homo sapiens
  Payload ID: 13493
  Gene Symbol: PRSS45
  Gene Name: protease, serine, 45
  Uniprot ID: Q7RTY3
  ENSP ID: ENSP00000480078
MTRHWPWEVSLRMENEHVCGGALIDPSWVVTAAHCIQGTKEYSVVLGTSKLQPMNFSRALWVPVRDIIMHPKYWGRAFIMGDVALVHLQTPVTFSEYVQPICLPEPNFNLKVGTQCWVTGWSQVKQRFSANSMLTPELQEAEVFIMDNKRCDRHYKKSFFPPVVPLVLGDMICATNYGENLCYGDSGGPLACEVEGRWILAGVLSWEKACVKAQNPGVYTRITKYTKWIKKQMSNGAFSGPCASACLLFLCWLLQPQMGS

SEQ ID NO: 67625 - protein, 174 aa, Homo sapiens
  Payload ID: 13494
  Gene Symbol: PRSS46
  Gene Name: protease, serine, 46
  Uniprot ID: E5RG02
  ENSP ID: ENSP00000430307
MACGPGDLQSLTSPLSSARLDYQPSIEGPWLRACGQTNVSCRVVKGKLVEVGKWPWQVSILFLGTYICSGSLIHHQWVLTAAHCLQRFKDLSLYSVMVGVHQRPENSTQLPLTRMVIHKDFSNLMSQDIALLKLRDSISWSPFVQPVCLPNIKFKPSIGSMCWVIGWGTTGKKG

SEQ ID NO: 67626 - protein, 328 aa, Homo sapiens
  Payload ID: 13495
  Gene Symbol: PRSS48
  Gene Name: protease, serine, 48
  Uniprot ID: Q7RTY5
  ENSP ID: ENSP00000401328
MGPAGCAFTLLLLLGISVCGQPVYSSRVVGGQDAAAGRWPWQVSLHFDHNFICGGSLVSERLILTAAHCIQPTWTTFSYTVWLGSITVGDSRKRVKYYVSKIVIHPKYQDTTADVALLKLSSQVTFTSAILPICLPSVTKQLAIPPFCWVTGWGKVKESSDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 67627 - protein, 185 aa, Homo sapiens
  Payload ID: 13495
  Gene Symbol: PRSS48
  Gene Name: protease, serine, 48
  Uniprot ID: Q7RTY5
  ENSP ID: ENSP00000401420
MGPAGCAFTLLLLLGISDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 67628 - protein, 385 aa, Homo sapiens
  Payload ID: 13496
  Gene Symbol: PRSS50
  Gene Name: protease, serine, 50
  Uniprot ID: Q9UI38
  ENSP ID: ENSP00000326598
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 67629 - protein, 385 aa, Homo sapiens; identical to SEQ ID NO: 67628
  Payload ID: 13496
  Gene Symbol: PRSS50
  Gene Name: protease, serine, 50
  Uniprot ID: Q9UI38
  ENSP ID: ENSP00000418875

SEQ ID NO: 67630 - protein, 553 aa, Homo sapiens
  Payload ID: 13497
  Gene Symbol: PRSS53
  Gene Name: protease, serine, 53
  Uniprot ID: Q2L4Q9
  ENSP ID: ENSP00000280606
MKWCWGPVLLIAGATVLMEGLQAAQRACGQRGPGPPKPQEGNTVPGEWPWQASVRRQGAHICSGSLVADTWVLTAAHCFEKAAATELNSWSVVLGSLQREGLSPGAEEVGVAALQLPRAYNHYSQGSDLALLQLAHPTTHTPLCLPQPAHRFPFGASCWATGWDQDTSDAPGTLRNLRLRLISRPTCNCIYNQLHQRHLSNPARPGMLCGGPQPGVQGPCQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCTSAVGELPSCEGLSGAPLVHEVRGTWFLAGLHSFGDACQGPARPAVFTALPAYEDWVSSLDWQVYFAEEPEPEAEPGSCLANISQPTSC

SEQ ID NO: 67631 - protein, 395 aa, Homo sapiens
  Payload ID: 13498
  Gene Symbol: PRSS54
  Gene Name: protease, serine, 54
  Uniprot ID: Q6PEW0
  ENSP ID: ENSP00000219301
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 67632 - protein, 296 aa, Homo sapiens
  Payload ID: 13498
  Gene Symbol: PRSS54
  Gene Name: protease, serine, 54
  ENSP ID: ENSP00000437705
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 67633 - protein, 395 aa, Homo sapiens; identical to SEQ ID NO: 67631
  Payload ID: 13498
  Gene Symbol: PRSS54
  Gene Name: protease, serine, 54
  Uniprot ID: Q6PEW0
  ENSP ID: ENSP00000455024

SEQ ID NO: 67634 - protein, 186 aa, Homo sapiens
  Payload ID: 13498
  Gene Symbol: PRSS54
  Gene Name: protease, serine, 54
  ENSP ID: ENSP00000455055
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRK

SEQ ID NO: 67635 - protein, 203 aa, Homo sapiens
  Payload ID: 13498
  Gene Symbol: PRSS54
  Gene Name: protease, serine, 54
  ENSP ID: ENSP00000455921
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYS

SEQ ID NO: 67636 - protein, 352 aa, Homo sapiens
  Payload ID: 13499
  Gene Symbol: PRSS55
  Gene Name: protease, serine, 55
  Uniprot ID: Q6UWB4
  ENSP ID: ENSP00000333003
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 67637 - protein, 182 aa, Homo sapiens
  Payload ID: 13499
  Gene Symbol: PRSS55
  Gene Name: protease, serine, 55
  ENSP ID: ENSP00000429376
  MOD_RES (1)..(1): Any amino acid
XWKPAPPSPVPSSHWMLTKCFPFSFPLSFFPPECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAGM

SEQ ID NO: 67638 - protein, 276 aa, Homo sapiens
  Payload ID: 13499
  Gene Symbol: PRSS55
  Gene Name: protease, serine, 55
  Uniprot ID: Q6UWB4
  ENSP ID: ENSP00000430459
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKQSYFPTLQRMNTGSSQTKPPGSHTFHLQN

SEQ ID NO: 67639 - protein, 604 aa, Homo sapiens
  Payload ID: 13500
  Gene Symbol: PRSS56
  Gene Name: protease, serine, 56
  ENSP ID: ENSP00000473410
MLLAVLLLLPLPSSWFAHGHPLYTRLPPSALQVLSAQGTQALQAAQRSAQWAINRVAMEIQHRSHECRGSGRPRPQALLQDPPEPGPCGERRPSTANVTRAHGRIVGGSAAPPGAWPWLVRLQLGGQPLCGGVLVAASWVLTAAHCFVGAPNELLWTVTLAEGSRGEQAEEVPVNRILPHPKFDPRTFHNDLALVQLWTPVSPGGSARPVCLPQEPQEPPAGTACAIAGWGALFEDGPEAEAVREARVPLLSTDTCRRALGPGLRPSTMLCAGYLAGGVDSCQGDSGGPLTCSEPGPRPREVLFGVTSWGDGCGEPGKPGVYTRVAVFKDWLQEQMSAASSSREPSCRELLAWDPPQELQADAARLCAFYARLCPGSQGACARLAHQQCLQRRRRCELRSLAHTLLGLLRNAQELLGPRPGLRRLAPALALPAPALRESPLHPARELRLHSGSRAAGTRFPKRRPEPRGEANGCPGLEPLRQKLAALQGAHAWILQVPSEHLAMNFHEVLADLGSKTLTGLFRAWVRAGLGGRHVAFSGLVGLEPATLARSLPRLLVQALQAFRVAALAEGEPEGPWMDVGQGPGLERKGHHPLNPQVPPARQP

SEQ ID NO: 67640 - protein, 603 aa, Homo sapiens
  Payload ID: 13500
  Gene Symbol: PRSS56
  Gene Name: protease, serine, 56
  Uniprot ID: P0CW18
  ENSP ID: ENSP00000479745
MLLAVLLLLPLPSSWFAHGHPLYTRLPPSALQVLSAQGTQALQAAQRSAQWAINRVAMEIQHRSHECRGSGRPRPQALLQDPPEPGPCGERRPSTANVTRAHGRIVGGSAAPPGAWPWLVRLQLGGQPLCGGVLVAASWVLTAAHCFVGAPNELLWTVTLAEGSRGEQAEEVPVNRILPHPKFDPRTFHNDLALVQLWTPVSPGGSARPVCLPQEPQEPPAGTACAIAGWGALFEDGPEAEAVREARVPLLSTDTCRRALGPGLRPSTMLCAGYLAGGVDSCQGDSGGPLTCSEPGPRPREVLFGVTSWGDGCGEPGKPGVYTRVAVFKDWLQEQMSASSSREPSCRELLAWDPPQELQADAARLCAFYARLCPGSQGACARLAHQQCLQRRRRCELRSLAHTLLGLLRNAQELLGPRPGLRRLAPALALPAPALRESPLHPARELRLHSGSRAAGTRFPKRRPEPRGEANGCPGLEPLRQKLAALQGAHAWILQVPSEHLAMNFHEVLADLGSKTLTGLFRAWVRAGLGGRHVAFSGLVGLEPATLARSLPRLLVQALQAFRVAALAEGEPEGPWMDVGQGPGLERKGHHPLNPQVPPARQP

SEQ ID NO: 67641 - protein, 282 aa, Homo sapiens
  Payload ID: 13501
  Gene Symbol: PRSS57
  Gene Name: protease, serine, 57
  ENSP ID: ENSP00000327386
MGLGLRGWGRPLLTVATALMLPVKPPGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 67642 - protein, 283 aa, Homo sapiens
  Payload ID: 13501
  Gene Symbol: PRSS57
  Gene Name: protease, serine, 57
  Uniprot ID: Q6UWY2
  ENSP ID: ENSP00000482358
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 67643 - protein, 241 aa, Homo sapiens
  Payload ID: 13502
  Gene Symbol: PRSS58
  Gene Name: protease, serine, 58
  Uniprot ID: Q8IYP2
  ENSP ID: ENSP00000446916
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 67644 - protein, 241 aa, Homo sapiens; identical to SEQ ID NO: 67643
  Payload ID: 13502
  Gene Symbol: PRSS58
  Gene Name: protease, serine, 58
  Uniprot ID: Q8IYP2
  ENSP ID: ENSP00000447588

SEQ ID NO: 67645 - protein, 241 aa, Homo sapiens; identical to SEQ ID NO: 67643
  Payload ID: 13502
  Gene Symbol: PRSS58
  Gene Name: protease, serine, 58
  Uniprot ID: Q8IYP2
  ENSP ID: ENSP00000478535

SEQ ID NO: 67646 - protein, 241 aa, Homo sapiens; identical to SEQ ID NO: 67643
  Payload ID: 13502
  Gene Symbol: PRSS58
  Gene Name: protease, serine, 58
  Uniprot ID: Q8IYP2
  ENSP ID: ENSP00000479165

SEQ ID NO: 67647 - protein, 343 aa, Homo sapiens
  Payload ID: 13503
  Gene Symbol: PRSS8
  Gene Name: protease, serine, 8
  Uniprot ID: Q16651
  ENSP ID: ENSP00000319730
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 67648 - protein, 195 aa, Homo sapiens
  Payload ID: 13503
  Gene Symbol: PRSS8
  Gene Name: protease, serine, 8
  ENSP ID: ENSP00000457673
MAQKGVLGPGQLGAVAILLYLGLLRSGTGAEGAEAPCGVAPQARITGGSSAVAGQWPWQVSITYEGVHVCGGSLVSEQWVLSAAHCFPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGK

SEQ ID NO: 67649 - protein, 289 aa, Homo sapiens
  Payload ID: 13503
  Gene Symbol: PRSS8
  Gene Name: protease, serine, 8
  Uniprot ID: Q16651
  ENSP ID: ENSP00000457750
MAQKGVLGPGQLGAVAILLYLGLLRSGTGAEGAEAPCGVAPQARITGGSSAVAGQWPWQVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 67650 - protein, 107 aa, Homo sapiens
  Payload ID: 13503
  Gene Symbol: PRSS8
  Gene Name: protease, serine, 8
  ENSP ID: ENSP00000458056
MAQKGVLGPGQLGAVAILLYLGLLRSGTAPCGVAPQARITGGSSAVAGQWPWQVSITYEGVHVCGGSLVSEQWVLSAAHCFPSEHHKEAYEVKLGAHQLDSYSEDAK

SEQ ID NO: 67651 - protein, 188 aa, Homo sapiens
  Payload ID: 13504
  Gene Symbol: PRADC1
  Gene Name: protease-associated domain containing 1
  Uniprot ID: Q9BSG0
  ENSP ID: ENSP00000258083
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 67652 - protein, 392 aa, Homo sapiens
  Payload ID: 13505
  Gene Symbol: PAAF1
  Gene Name: proteasomal ATPase-associated factor 1
  Uniprot ID: Q9BRP4
  ENSP ID: ENSP00000311665
MAAPLRIQSDWAQALRKDEGEAWLSCHPPGKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 67653 - protein, 375 aa, Homo sapiens
  Payload ID: 13505
  Gene Symbol: PAAF1
  Gene Name: proteasomal ATPase-associated factor 1
  Uniprot ID: Q9BRP4
  ENSP ID: ENSP00000365564
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 67654 - protein, 393 aa, Homo sapiens
  Payload ID: 13505
  Gene Symbol: PAAF1
  Gene Name: proteasomal ATPase-associated factor 1
  ENSP ID: ENSP00000438071
MLELKPSSVDSKFSTTMQAYVFPRCFGTAWVLTSFFPSYSDLDTVFITSNMIANFCCEPAEWVQTKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 67655 - protein, 375 aa, Homo sapiens; identical to SEQ ID NO: 67653
  Payload ID: 13505
  Gene Symbol: PAAF1
  Gene Name: proteasomal ATPase-associated factor 1
  Uniprot ID: Q9BRP4
  ENSP ID: ENSP00000438124

SEQ ID NO: 67656 - protein, 277 aa, Homo sapiens
  Payload ID: 13505
  Gene Symbol: PAAF1
  Gene Name: proteasomal ATPase-associated factor 1
  Uniprot ID: Q9BRP4
  ENSP ID: ENSP00000438789
MKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 67657 - protein, 247 aa, Homo sapiens
  Payload ID: 13505
  Gene Symbol: PAAF1
  Gene Name: proteasomal ATPase-associated factor 1
  ENSP ID: ENSP00000438894
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQ

SEQ ID NO: 67658 - protein, 100 aa, Homo sapiens
  Payload ID: 13505
  Gene Symbol: PAAF1
  Gene Name: proteasomal ATPase-associated factor 1
  ENSP ID: ENSP00000439143
MKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLA

SEQ ID NO: 67659 - protein, 237 aa, Homo sapiens
  Payload ID: 13505
  Gene Symbol: PAAF1
  Gene Name: proteasomal ATPase-associated factor 1
  ENSP ID: ENSP00000439747
MLVPCFLYSLQNRKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKML

SEQ ID NO: 67660 - protein, 161 aa, Homo sapiens
  Payload ID: 13505
  Gene Symbol: PAAF1
  Gene Name: proteasomal ATPase-associated factor 1
  ENSP ID: ENSP00000439877
MENSGFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAG

SEQ ID NO: 67661 - protein, 277 aa, Homo sapiens; identical to SEQ ID NO: 67656
  Payload ID: 13505
  Gene Symbol: PAAF1
  Gene Name: proteasomal ATPase-associated factor 1
  Uniprot ID: Q9BRP4
  ENSP ID: ENSP00000441333

SEQ ID NO: 67662 - protein, 375 aa, Homo sapiens; identical to SEQ ID NO: 67653
  Payload ID: 13505
  Gene Symbol: PAAF1
  Gene Name: proteasomal ATPase-associated factor 1
  Uniprot ID: Q9BRP4
  ENSP ID: ENSP00000441494

SEQ ID NO: 67663 - protein, 117 aa, Homo sapiens
  Payload ID: 13505
  Gene Symbol: PAAF1
  Gene Name: proteasomal ATPase-associated factor 1
  ENSP ID: ENSP00000442434
  MOD_RES (1)..(1): Any amino acid
XWSAEDASCVVTFKGHKGGILDTAIVDRGRNVVSASRDGTARLWDCGRSACLGVLADCGSSINGVAVGAADNSINLGSPEQMPSVPLYWLRRFQLLYFSLWLLAIGWDSRWKHLSAG

SEQ ID NO: 67664 - protein, 150 aa, Homo sapiens
  Payload ID: 13505
  Gene Symbol: PAAF1
  Gene Name: proteasomal ATPase-associated factor 1
  ENSP ID: ENSP00000443473
MLLLYHIGKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTF

SEQ ID NO: 67665 - protein, 288 aa, Homo sapiens
  Payload ID: 13506
  Gene Symbol: PSMG1
  Gene Name: proteasome (prosome, macropain) assembly chaperone 1
  Uniprot ID: O95456
  ENSP ID: ENSP00000329915
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFLCQCSCYVAEDQQYQWLEKVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 67666 - protein, 267 aa, Homo sapiens
  Payload ID: 13506
  Gene Symbol: PSMG1
  Gene Name: proteasome (prosome, macropain) assembly chaperone 1
  Uniprot ID: O95456
  ENSP ID: ENSP00000370286
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 67667 - protein, 63 aa, Homo sapiens
  Payload ID: 13506
  Gene Symbol: PSMG1
  Gene Name: proteasome (prosome, macropain) assembly chaperone 1
  ENSP ID: ENSP00000398569
MAATFFGEVVKAPCRAGTEDEEEEEEGRRETPEDREVRLQLARKSISVIICYEFRSLGGSWLC

SEQ ID NO: 67668 - protein, 13 aa, Homo sapiens
  Payload ID: 13506
  Gene Symbol: PSMG1
  Gene Name: proteasome (prosome, macropain) assembly chaperone 1
  ENSP ID: ENSP00000410810
  MOD_RES (1)..(1): Any amino acid
XDREVRLQLARKR

SEQ ID NO: 67669 - protein, 264 aa, Homo sapiens
  Payload ID: 13507
  Gene Symbol: PSMG2
  Gene Name: proteasome (prosome, macropain) assembly chaperone 2
  Uniprot ID: Q969U7
  ENSP ID: ENSP00000325919
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 67670 - protein, 240 aa, Homo sapiens
  Payload ID: 13507
  Gene Symbol: PSMG2
  Gene Name: proteasome (prosome, macropain) assembly chaperone 2
  ENSP ID: ENSP00000467060
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLVSSIIA

SEQ ID NO: 67671 - protein, 98 aa, Homo sapiens
  Payload ID: 13507
  Gene Symbol: PSMG2
  Gene Name: proteasome (prosome, macropain) assembly chaperone 2
  ENSP ID: ENSP00000468103
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKLF

SEQ ID NO: 67672 - protein, 233 aa, Homo sapiens
  Payload ID: 13507
  Gene Symbol: PSMG2
  Gene Name: proteasome (prosome, macropain) assembly chaperone 2
  Uniprot ID: Q969U7
  ENSP ID: ENSP00000476763
MDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 67673 - protein, 209 aa, Homo sapiens
  Payload ID: 13507
  Gene Symbol: PSMG2
  Gene Name: proteasome (prosome, macropain) assembly chaperone 2
  ENSP ID: ENSP00000477442
MQQSQVQALSCFTPKAVAIRTPLRNVWPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQM

SEQ ID NO: 67674 - protein, 122 aa, Homo sapiens
  Payload ID: 13508
  Gene Symbol: PSMG3
  Gene Name: proteasome (prosome, macropain) assembly chaperone 3
  Uniprot ID: Q9BT73
  ENSP ID: ENSP00000252329
MEDTPLVISKQKTEVVCGVPTQVVCTAFSSHILVVVTQFGKMGTLVSLEPSSVASDVSKPVLTTKVLLGQDEPLIHVFAKNLVAFVSQEAGNRAVLLAVAVKDKSMEGLKALREVIRVCQVW

SEQ ID NO: 67675 - protein, 122 aa, Homo sapiens; identical to SEQ ID NO: 67674
  Payload ID: 13508
  Gene Symbol: PSMG3
  Gene Name: proteasome (prosome, macropain) assembly chaperone 3
  Uniprot ID: Q9BT73
  ENSP ID: ENSP00000288607

SEQ ID NO: 67676 - protein, 122 aa, Homo sapiens; identical to SEQ ID NO: 67674
  Payload ID: 13508
  Gene Symbol: PSMG3
  Gene Name: proteasome (prosome, macropain) assembly chaperone 3
  Uniprot ID: Q9BT73
  ENSP ID: ENSP00000384799

SEQ ID NO: 67677 - protein, 82 aa, Homo sapiens
  Payload ID: 13509
  Gene Symbol: PSMG4
  Gene Name: proteasome (prosome, macropain) assembly chaperone 4
  ENSP ID: ENSP00000369660
MEGLVVAAGGDVSLHNFSARLWEQLVHFHVMRLTDSLFLWVGATPHLRNLAVAMCSRYPGRPTNRCLSAITFRTQTVTSHYL

SEQ ID NO: 67678 - protein, 124 aa, Homo sapiens
  Payload ID: 13509
  Gene Symbol: PSMG4
  Gene Name: proteasome (prosome, macropain) assembly chaperone 4
  ENSP ID: ENSP00000369661
MSPQLTSAFRNLPKTFVCHLNEMKTNKHTWNMLLFLRSWLHRSTTSPAYHVLVILFEEQGHTDGLHVRSGGSRMFGGSRSKINSARKTNKQVFVSYNLQNTDSNFALLVENRIKEEMEAFPEKF

SEQ ID NO: 67679 - protein, 162 aa, Homo sapiens
  Payload ID: 13509
  Gene Symbol: PSMG4
  Gene Name: proteasome (prosome, macropain) assembly chaperone 4
  Uniprot ID: Q5JS54
  ENSP ID: ENSP00000392353
MEGLVVAAGGDVSLHNFSARLWEQLVHFHVMRLTDSLFLWVGATPHLRNLAVAMCSRYDSIPVSTSLLGDTSDTTSTGLAQRLGLGGKTGLACECGVEWGLSKGHEAECSTLPTPQHTSCGPARKTNKQVFVSYNLQNTDSNFALLVENRIKEEMEAFPEKF

SEQ ID NO: 67680 - protein, 76 aa, Homo sapiens
  Payload ID: 13509
  Gene Symbol: PSMG4
  Gene Name: proteasome (prosome, macropain) assembly chaperone 4
  ENSP ID: ENSP00000407702
MEGLVVAAGGDVSLHNFSARLWEQLVHFHVMRLTDSLFLWVGATPHLRNLAVAMCSRYTGSEPAVGLRYPATASTK

SEQ ID NO: 67681 - protein, 123 aa, Homo sapiens
  Payload ID: 13509
  Gene Symbol: PSMG4
  Gene Name: proteasome (prosome, macropain) assembly chaperone 4
  Uniprot ID: Q5JS54
  ENSP ID: ENSP00000413353
MEGLVVAAGGDVSLHNFSARLWEQLVHFHVMRLTDSLFLWVGATPHLRNLAVAMCSRYDSIPVSTSLLGDTSDTTSTGLAQRLARKTNKQVFVSYNLQNTDSNFALLVENRIKEEMEAFPEKF

SEQ ID NO: 67682 - protein, 117 aa, Homo sapiens
  Payload ID: 13509
  Gene Symbol: PSMG4
  Gene Name: proteasome (prosome, macropain) assembly chaperone 4
  ENSP ID: ENSP00000415768
  MOD_RES (1)..(1): Any amino acid
XLHNFSARLWEQLVHFHVMRLTDSLFLWVGATPHLRNLAVAMCSRYVPCPHHLHDADLLGPPGKLFLQLCKETDPVSPGQAAHRGQDSSCSHSPGSPVRVPQKGERSFFFFFFFASG

SEQ ID NO: 67683 - protein, 104 aa, Homo sapiens
  Payload ID: 13509
  Gene Symbol: PSMG4
  Gene Name: proteasome (prosome, macropain) assembly chaperone 4
  Uniprot ID: Q5JS54
  ENSP ID: ENSP00000418241
MEGLVVAAGGDVSLHNFSARLWEQLVHFHVMRLTDSLFLWVGATPHLRNLAVAMCSRYDSIPVSTSLLGDTSDTTSTGLAQRLGMYPQLALHGQPGGAHSLMEP

SEQ ID NO: 67684 - protein, 35 aa, Homo sapiens
  Payload ID: 13509
  Gene Symbol: PSMG4
  Gene Name: proteasome (prosome, macropain) assembly chaperone 4
  ENSP ID: ENSP00000422147
MSPQLTSAFRNLPKTFVCHLNEMKTFPSTLLQEFP

SEQ ID NO: 67685 - protein, 108 aa, Homo sapiens
  Payload ID: 13509
  Gene Symbol: PSMG4
  Gene Name: proteasome (prosome, macropain) assembly chaperone 4
  ENSP ID: ENSP00000424330
MEGLVVAAGGDVSLHNFSARLWEQLVHFHVMRLTDSLFLWVGATPHLRNLAVAMCSRYDSIPVSTSLLGDTSDTTSTGLAQRLGRTVLTQCDTVQGSEGRLAWPVSVA

SEQ ID NO: 67686 - protein, 300 aa, Homo sapiens
  Payload ID: 13510
  Gene Symbol: PSMB11
  Gene Name: proteasome (prosome, macropain) subunit, beta type, 11
  Uniprot ID: A5LHX3
  ENSP ID: ENSP00000386212
MALQDVCKWQSPDTQGPSPHLPRAGGWAVPRGCDPQTFLQIHGPRLAHGTTTLAFRFRHGVIAAADTRSSCGSYVACPASCKVIPVHQHLLGTTSGTSADCATWYRVLQRELRLRELREGQLPSVASAAKLLSAMMSQYRGLDLCVATALCGWDRSGPELFYVYSDGTRLQGDIFSVGSGSPYAYGVLDRGYRYDMSTQEAYALARCAVAHATHRDAYSGGSVDLFHVRESGWEHVSRSDACVLYVELQKLLEPEPEEDASHAHPEPATAHRAAEDRELSVGPGEVTPGDSRMPAGTETV

SEQ ID NO: 67687 - protein, 440 aa, Homo sapiens
  Payload ID: 13511
  Gene Symbol: PSMC1
  Gene Name: proteasome 26S subunit, ATPase 1
  Uniprot ID: P62191
  ENSP ID: ENSP00000261303
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 67688 - protein, 367 aa, Homo sapiens
  Payload ID: 13511
  Gene Symbol: PSMC1
  Gene Name: proteasome 26S subunit, ATPase 1
  Uniprot ID: P62191
  ENSP ID: ENSP00000445147
MEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 67689 - protein, 84 aa, Homo sapiens
  Payload ID: 13511
  Gene Symbol: PSMC1
  Gene Name: proteasome 26S subunit, ATPase 1
  ENSP ID: ENSP00000452049
MDDTDPLVTVMKVEKAPQETYADIGGLDNQIQEIKESVELPLTHPEYYEEMGIKPPKGVILYGPPGTGKTLLAKAVANQTSATF

SEQ ID NO: 67690 - protein, 433 aa, Homo sapiens
  Payload ID: 13512
  Gene Symbol: PSMC2
  Gene Name: proteasome 26S subunit, ATPase 2
  Uniprot ID: P35998
  ENSP ID: ENSP00000292644
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 67691 - protein, 433 aa, Homo sapiens; identical to SEQ ID NO: 67690
  Payload ID: 13512
  Gene Symbol: PSMC2
  Gene Name: proteasome 26S subunit, ATPase 2
  Uniprot ID: P35998
  ENSP ID: ENSP00000391211

SEQ ID NO: 67692 - protein, 130 aa, Homo sapiens
  Payload ID: 13512
  Gene Symbol: PSMC2
  Gene Name: proteasome 26S subunit, ATPase 2
  ENSP ID: ENSP00000393027
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVA

SEQ ID NO: 67693 - protein, 130 aa, Homo sapiens; identical to SEQ ID NO: 67692
  Payload ID: 13512
  Gene Symbol: PSMC2
  Gene Name: proteasome 26S subunit, ATPase 2
  ENSP ID: ENSP00000401724

SEQ ID NO: 67694 - protein, 439 aa, Homo sapiens
  Payload ID: 13513
  Gene Symbol: PSMC3
  Gene Name: proteasome 26S subunit, ATPase 3
  Uniprot ID: P17980
  ENSP ID: ENSP00000298852
MNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 67695 - protein, 301 aa, Homo sapiens
  Payload ID: 13513
  Gene Symbol: PSMC3
  Gene Name: proteasome 26S subunit, ATPase 3
  ENSP ID: ENSP00000431144
DEAEVGTGRAGGPGTGARRETPLTRGKEVAGGQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTK

SEQ ID NO: 67696 - protein, 37 aa, Homo sapiens
  Payload ID: 13513
  Gene Symbol: PSMC3
  Gene Name: proteasome 26S subunit, ATPase 3
  ENSP ID: ENSP00000432103
MATVWDEAEMELGRRCSRCPRRRSSSAHGCWTVRSRS

SEQ ID NO: 67697 - protein, 257 aa, Homo sapiens
  Payload ID: 13513
  Gene Symbol: PSMC3
  Gene Name: proteasome 26S subunit, ATPase 3
  ENSP ID: ENSP00000432970
MATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTK

SEQ ID NO: 67698 - protein, 397 aa, Homo sapiens
  Payload ID: 13513
  Gene Symbol: PSMC3
  Gene Name: proteasome 26S subunit, ATPase 3
  ENSP ID: ENSP00000433097
MNLLPNIESPVTRQEKMATVWDEAEQDGIGEEVLKMSTEEIIQRTRLLDSEIKLLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 67699 - protein, 311 aa, Homo sapiens
  Payload ID: 13513
  Gene Symbol: PSMC3
  Gene Name: proteasome 26S subunit, ATPase 3
  ENSP ID: ENSP00000433596
TVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDR

SEQ ID NO: 67700 - protein, 184 aa, Homo sapiens
  Payload ID: 13513
  Gene Symbol: PSMC3
  Gene Name: proteasome 26S subunit, ATPase 3
  ENSP ID: ENSP00000435141
MATVWDEAEVGTGRAGGPGTGARRETPLTRGKEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAME

SEQ ID NO: 67701 - protein, 52 aa, Homo sapiens
  Payload ID: 13513
  Gene Symbol: PSMC3
  Gene Name: proteasome 26S subunit, ATPase 3
  ENSP ID: ENSP00000437291
TGRAGGPGTGARRETPLTRGKEVAGGQARWNWGGGAQDVHGGDHPAHTAAGQ

SEQ ID NO: 67702 - protein, 423 aa, Homo sapiens
  Payload ID: 13513
  Gene Symbol: PSMC3
  Gene Name: proteasome 26S subunit, ATPase 3
  ENSP ID: ENSP00000473652
MATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 67703 - protein, 439 aa, Homo sapiens; identical to SEQ ID NO: 67694
  Payload ID: 13513
  Gene Symbol: PSMC3
  Gene Name: proteasome 26S subunit, ATPase 3
  Uniprot ID: P17980
  ENSP ID: ENSP00000481029

SEQ ID NO: 67704 - protein, 418 aa, Homo sapiens
  Payload ID: 13514
  Gene Symbol: PSMC4
  Gene Name: proteasome 26S subunit, ATPase 4
  Uniprot ID: P43686
  ENSP ID: ENSP00000157812
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 67705 - protein, 387 aa, Homo sapiens
  Payload ID: 13514
  Gene Symbol: PSMC4
  Gene Name: proteasome 26S subunit, ATPase 4
  Uniprot ID: P43686
  ENSP ID: ENSP00000413869
MEEIGILVEKAQDEIPALSVSRPQTGLSFLGPEPEDLEDLYSRYKEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 67706 - protein, 387 aa, Homo sapiens; identical to SEQ ID NO: 67705
  Payload ID: 13514
  Gene Symbol: PSMC4
  Gene Name: Proteasome 26S subunit, ATPase 4
  ENSP ID: ENSP00000485851

SEQ ID NO: 67707 - protein, 418 aa, Homo sapiens; identical to SEQ ID NO: 67704
  Payload ID: 13514
  Gene Symbol: PSMC4
  Gene Name: Proteasome 26S subunit, ATPase 4
  ENSP ID: ENSP00000487367

SEQ ID NO: 67708 - protein, 406 aa, Homo sapiens
  Payload ID: 13515
  Gene Symbol: PSMC5
  Gene Name: proteasome 26S subunit, ATPase 5
  Uniprot ID: P62195
  ENSP ID: ENSP00000310572
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 67709 - protein, 398 aa, Homo sapiens
  Payload ID: 13515
  Gene Symbol: PSMC5
  Gene Name: proteasome 26S subunit, ATPase 5
  Uniprot ID: P62195
  ENSP ID: ENSP00000364970
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 67710 - protein, 241 aa, Homo sapiens
  Payload ID: 13515
  Gene Symbol: PSMC5
  Gene Name: proteasome 26S subunit, ATPase 5
  ENSP ID: ENSP00000462098
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMD

SEQ ID NO: 67711 - protein, 398 aa, Homo sapiens; identical to SEQ ID NO: 67709
  Payload ID: 13515
  Gene Symbol: PSMC5
  Gene Name: proteasome 26S subunit, ATPase 5
  Uniprot ID: P62195
  ENSP ID: ENSP00000462495

SEQ ID NO: 67712 - protein, 52 aa, Homo sapiens
  Payload ID: 13515
  Gene Symbol: PSMC5
  Gene Name: proteasome 26S subunit, ATPase 5
  ENSP ID: ENSP00000463107
MALDGPEQMELEEGKAGSGLRQYYLSKIEELQFAYCGRSYSCCRSRAPMWGK

SEQ ID NO: 67713 - protein, 215 aa, Homo sapiens
  Payload ID: 13515
  Gene Symbol: PSMC5
  Gene Name: proteasome 26S subunit, ATPase 5
  ENSP ID: ENSP00000463549
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKF

SEQ ID NO: 67714 - protein, 263 aa, Homo sapiens
  Payload ID: 13515
  Gene Symbol: PSMC5
  Gene Name: proteasome 26S subunit, ATPase 5
  ENSP ID: ENSP00000463801
MALDGPEQMELEEGKAGSGLRQYYLSKIEELQLIVNDKSQNLRRLQAQRNELNAKVRLLREELQLLQEQGSYVGEVVRAMDKKKVLVKVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDG

SEQ ID NO: 67715 - protein, 398 aa, Homo sapiens; identical to SEQ ID NO: 67709
  Payload ID: 13515
  Gene Symbol: PSMC5
  Gene Name: proteasome 26S subunit, ATPase 5
  Uniprot ID: P62195
  ENSP ID: ENSP00000463938

SEQ ID NO: 67716 - protein, 127 aa, Homo sapiens
  Payload ID: 13515
  Gene Symbol: PSMC5
  Gene Name: proteasome 26S subunit, ATPase 5
  ENSP ID: ENSP00000464347
  MOD_RES (1)..(1): Any amino acid
XTYEMIGGLDKQIKEIKEVIELPVKHPELFEALGIAQPKGVLLYGPPGTGKTLLARAVAHHTDCTFIRVSGSELVQKFIGEARPPHRGKNGEGAVCHGTGTCSIYHLHGRNRLHRLLAAGGGFWRGQ

SEQ ID NO: 67717 - protein, 143 aa, Homo sapiens
  Payload ID: 13515
  Gene Symbol: PSMC5
  Gene Name: proteasome 26S subunit, ATPase 5
  ENSP ID: ENSP00000464405
MALDGPEQVWRVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELV

SEQ ID NO: 67718 - protein, 257 aa, Homo sapiens
  Payload ID: 13515
  Gene Symbol: PSMC5
  Gene Name: proteasome 26S subunit, ATPase 5
  ENSP ID: ENSP00000464602
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGG

SEQ ID NO: 67719 - protein, 169 aa, Homo sapiens
  Payload ID: 13515
  Gene Symbol: PSMC5
  Gene Name: proteasome 26S subunit, ATPase 5
  ENSP ID: ENSP00000464646
MALDGPEQMELEEGKAGSGLRQYYLSKIEELQLIVNDKSQNLRRLQAQRNELNAKVRLLREELQLLQEQGSYVGEVVRAMDKKKVLVKVTPNCRVALRNDSYTLHKILPNKVDPLVSLMMVEKVPDSTYEMIGGLDKQIKEIKEVIELPVKHPELFEALGIAQPKGQEW

SEQ ID NO: 67720 - protein, 403 aa, Homo sapiens
  Payload ID: 13516
  Gene Symbol: PSMC6
  Gene Name: proteasome 26S subunit, ATPase 6
  ENSP ID: ENSP00000401802
MAIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 67721 - protein, 262 aa, Homo sapiens
  Payload ID: 13516
  Gene Symbol: PSMC6
  Gene Name: proteasome 26S subunit, ATPase 6
  ENSP ID: ENSP00000451156
  MOD_RES (1)..(1): Any amino acid
XADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIDYEAIVKLSDGFNGADLRNVCTEA

SEQ ID NO: 67722 - protein, 33 aa, Homo sapiens
  Payload ID: 13516
  Gene Symbol: PSMC6
  Gene Name: proteasome 26S subunit, ATPase 6
  ENSP ID: ENSP00000451241
  MOD_RES (1)..(1): Any amino acid
XRDKALQDYRKKLLEHKEIDGRLKECECTFLSI

SEQ ID NO: 67723 - protein, 70 aa, Homo sapiens
  Payload ID: 13516
  Gene Symbol: PSMC6
  Gene Name: proteasome 26S subunit, ATPase 6
  ENSP ID: ENSP00000451340
MADPRDKALQDYRKKLLEHKEIDGRLKELREQLKELTKQYEKSENDLKALQSVGQIVGEVLKQLTEEKCE

SEQ ID NO: 67724 - protein, 194 aa, Homo sapiens
  Payload ID: 13516
  Gene Symbol: PSMC6
  Gene Name: proteasome 26S subunit, ATPase 6
  ENSP ID: ENSP00000452048
MADPRDKALQDYRKKLLEHKEIDGRLKEFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDE

SEQ ID NO: 67725 - protein, 97 aa, Homo sapiens
  Payload ID: 13516
  Gene Symbol: PSMC6
  Gene Name: proteasome 26S subunit, ATPase 6
  ENSP ID: ENSP00000452072
MADPRDKALQDYRKKLLEHKEIDGRLKELREQLKELTKQYEKSENDLKALQSVGQIVGEVLKQLTEEKFIVKATNGPRYVVGCRRQIFAERGGSTGL

SEQ ID NO: 67726 - protein, 14 aa, Homo sapiens
  Payload ID: 13516
  Gene Symbol: PSMC6
  Gene Name: proteasome 26S subunit, ATPase 6
  ENSP ID: ENSP00000452253
  MOD_RES (1)..(1): Any amino acid
XGRLKECECTFLSI

SEQ ID NO: 67727 - protein, 67 aa, Homo sapiens
  Payload ID: 13516
  Gene Symbol: PSMC6
  Gene Name: proteasome 26S subunit, ATPase 6
  ENSP ID: ENSP00000452388
  MOD_RES (1)..(1): Any amino acid
XVSSSIVDKYIGESARLIREMFNYARDHQPCIIFMDEIDAIGGRRFSEGTSADREIQRTLMEIMKQL

SEQ ID NO: 67728 - protein, 36 aa, Homo sapiens
  Payload ID: 13516
  Gene Symbol: PSMC6
  Gene Name: proteasome 26S subunit, ATPase 6
  ENSP ID: ENSP00000452511
MADPRDKALQDYRKKLLEHKEIDGRLKECECTFLSI

SEQ ID NO: 67729 - protein, 389 aa, Homo sapiens
  Payload ID: 13516
  Gene Symbol: PSMC6
  Gene Name: proteasome 26S subunit, ATPase 6
  Uniprot ID: P62333
  ENSP ID: ENSP00000475721
MADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 67730 - protein, 403 aa, Homo sapiens; identical to SEQ ID NO: 67720
  Payload ID: 13516
  Gene Symbol: PSMC6
  Gene Name: proteasome 26S subunit, ATPase 6
  ENSP ID: ENSP00000484998

SEQ ID NO: 67731 - protein, 953 aa, Homo sapiens
  Payload ID: 13517
  Gene Symbol: PSMD1
  Gene Name: proteasome 26S subunit, non-ATPase 1
  Uniprot ID: Q99460
  ENSP ID: ENSP00000309474
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 67732 - protein, 922 aa, Homo sapiens
  Payload ID: 13517
  Gene Symbol: PSMD1
  Gene Name: proteasome 26S subunit, non-ATPase 1
  Uniprot ID: Q99460
  ENSP ID: ENSP00000362738
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 67733 - protein, 922 aa, Homo sapiens; identical to SEQ ID NO: 67732
  Payload ID: 13517
  Gene Symbol: PSMD1
  Gene Name: proteasome 26S subunit, non-ATPase 1
  Uniprot ID: Q99460
  ENSP ID: ENSP00000386932

SEQ ID NO: 67734 - protein, 164 aa, Homo sapiens
  Payload ID: 13517
  Gene Symbol: PSMD1
  Gene Name: proteasome 26S subunit, non-ATPase 1
  ENSP ID: ENSP00000390967
  MOD_RES (1)..(1): Any amino acid
XAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQNLRTVGTPIASVPGSTNTGTVPGSEKDSDSMETEEKTSSAFVGKTP

SEQ ID NO: 67735 - protein, 48 aa, Homo sapiens
  Payload ID: 13517
  Gene Symbol: PSMD1
  Gene Name: proteasome 26S subunit, non-ATPase 1
  ENSP ID: ENSP00000400483
MITSAAGIISLLDEDEPQLKEFALHKLNAVVNDFWAEISESVDKIKMH

SEQ ID NO: 67736 - protein, 203 aa, Homo sapiens
  Payload ID: 13517
  Gene Symbol: PSMD1
  Gene Name: proteasome 26S subunit, non-ATPase 1
  ENSP ID: ENSP00000406141
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIGNYRLSAKCIDHYTKQCVENADLPEGEKKPIDQRLEGIVNKMFQRCLDDHKYKQAIGIALETRRLDVFEKTILESNDVPGMLAYSLKLCMSLMQNKQFRNKV

SEQ ID NO: 67737 - protein, 192 aa, Homo sapiens
  Payload ID: 13517
  Gene Symbol: PSMD1
  Gene Name: proteasome 26S subunit, non-ATPase 1
  ENSP ID: ENSP00000410061
  MOD_RES (1)..(1): Any amino acid
XGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKVKPTANGVSSFLAPDCFPSPQNLCNSCKNTSAM

SEQ ID NO: 67738 - protein, 953 aa, Homo sapiens [sequence omitted]

SEQ ID NO: 67739 - protein, 226 aa, Homo sapiens
  Payload ID: 13518
  Gene Symbol: PSMD10
  Gene Name: proteasome 26S subunit, non-ATPase 10
  Uniprot ID: O75832
  ENSP ID: ENSP00000217958
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 67740 - protein, 193 aa, Homo sapiens
  Payload ID: 13518
  Gene Symbol: PSMD10
  Gene Name: proteasome 26S subunit, non-ATPase 10
  ENSP ID: ENSP00000345963
MEGCVSNLMVCNLAYSGKLEELKESILADKSLATRTDQAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 67741 - protein, 151 aa, Homo sapiens
  Payload ID: 13518
  Gene Symbol: PSMD10
  Gene Name: proteasome 26S subunit, non-ATPase 10
  Uniprot ID: O75832
  ENSP ID: ENSP00000354906
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKDT

SEQ ID NO: 67742 - protein, 185 aa, Homo sapiens
  Payload ID: 13518
  Gene Symbol: PSMD10
  Gene Name: proteasome 26S subunit, non-ATPase 10
  ENSP ID: ENSP00000361369
MEGCVSNLMVCNLAYSGKLEELKESILADKSLATRTDQDSRTALHWACSAGHTEIVEFLLQLGVPVNDKDDAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 67743 - protein, 110 aa, Homo sapiens
  Payload ID: 13518
  Gene Symbol: PSMD10
  Gene Name: proteasome 26S subunit, non-ATPase 10
  ENSP ID: ENSP00000361370
MEGCVSNLMVCNLAYSGKLEELKESILADKSLATRTDQDSRTALHWACSAGHTEIVEFLLQLGVPVNDKDDAASKNRHEIAVMLLEGGANPDAKDHYEATAMHRAAAKDT

SEQ ID NO: 67744 - protein, 422 aa, Homo sapiens
  Payload ID: 13519
  Gene Symbol: PSMD11
  Gene Name: proteasome 26S subunit, non-ATPase 11
  Uniprot ID: O00231
  ENSP ID: ENSP00000261712
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 67745 - protein, 422 aa, Homo sapiens; identical to SEQ ID NO: 67744
  Payload ID: 13519
  Gene Symbol: PSMD11
  Gene Name: proteasome 26S subunit, non-ATPase 11
  Uniprot ID: O00231
  ENSP ID: ENSP00000393185

SEQ ID NO: 67746 - protein, 45 aa, Homo sapiens
  Payload ID: 13519
  Gene Symbol: PSMD11
  Gene Name: proteasome 26S subunit, non-ATPase 11
  ENSP ID: ENSP00000462683
MEAATGQEVELCLECIEWAKSEKRTFLRQALEARLVSLYFDTKRY

SEQ ID NO: 67747 - protein, 5 aa, Homo sapiens
  Payload ID: 13519
  Gene Symbol: PSMD11
  Gene Name: proteasome 26S subunit, non-ATPase 11
  ENSP ID: ENSP00000463728
MEAAT

SEQ ID NO: 67748 - protein, 187 aa, Homo sapiens
  Payload ID: 13519
  Gene Symbol: PSMD11
  Gene Name: proteasome 26S subunit, non-ATPase 11
  ENSP ID: ENSP00000464434
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEFLFVTGHLILWVCSMLCFVSGDCQWSLESSLHQGHKLILVFEVELCLECIEWAKSEKRTFLRQALEARLVSLYFDTKRYQE

SEQ ID NO: 67749 - protein, 90 aa, Homo sapiens
  Payload ID: 13519
  Gene Symbol: PSMD11
  Gene Name: proteasome 26S subunit, non-ATPase 11
  ENSP ID: ENSP00000464475
  MOD_RES (1)..(1): Any amino acid
XKTYHALSNLPKARAALTSARTTANAIYCPPKLQATLDMQSGIIHAAEEKDWKTAYSYFYEAFEGYDSIDSPKAITSLKYMLLCKIMLNT

SEQ ID NO: 67750 - protein, 456 aa, Homo sapiens
  Payload ID: 13520
  Gene Symbol: PSMD12
  Gene Name: proteasome 26S subunit, non-ATPase 12
  Uniprot ID: O00232
  ENSP ID: ENSP00000348442
MADGGSERADGRIVKMEVDYSATVDQRLPECAKLAKEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 67751 - protein, 436 aa, Homo sapiens
  Payload ID: 13520
  Gene Symbol: PSMD12
  Gene Name: proteasome 26S subunit, non-ATPase 12
  Uniprot ID: O00232
  ENSP ID: ENSP00000349667
MADGGSERADGRIVKMEVDYSATVDQRLPECAKLAKASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 67752 - protein, 42 aa, Homo sapiens
  Payload ID: 13520
  Gene Symbol: PSMD12
  Gene Name: proteasome 26S subunit, non-ATPase 12
  ENSP ID: ENSP00000462525
MADGGSERADGRIVKMEVDYSATVDQRLPECAKLAKACLYRY

SEQ ID NO: 67753 - protein, 38 aa, Homo sapiens
  Payload ID: 13520
  Gene Symbol: PSMD12
  Gene Name: proteasome 26S subunit, non-ATPase 12
  ENSP ID: ENSP00000463017
MADGGSERADGRIVKMEVDYSATVDQRLPECAKLAKVV

SEQ ID NO: 67754 - protein, 349 aa, Homo sapiens
  Payload ID: 13521
  Gene Symbol: PSMD13
  Gene Name: proteasome 26S subunit, non-ATPase 13
  ENSP ID: ENSP00000333811
MKDVPGFLQQSQNSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEVELLVMKALSVGLVKGSIDEVDKRVHMTWVQPRVLDLQQIKGMKDRLEFWCTDVKSMEMLVEHQAHDILT

SEQ ID NO: 67755 - protein, 72 aa, Homo sapiens
  Payload ID: 13521
  Gene Symbol: PSMD13
  Gene Name: proteasome 26S subunit, non-ATPase 13
  ENSP ID: ENSP00000372117
MKDVPGFLQQSQNSGPGQPAVWHRLEELYTKKLWHQLTLQVLDFVQDPCFAQGDGLIKGEPFVPRGNHSSCS

SEQ ID NO: 67756 - protein, 378 aa, Homo sapiens
  Payload ID: 13521
  Gene Symbol: PSMD13
  Gene Name: proteasome 26S subunit, non-ATPase 13
  Uniprot ID: Q9UNM6
  ENSP ID: ENSP00000396937
MKDVPGFLQQSQNSGPGQPAVWHRLEELYTKNFMKTLSVNLNTGKSLSSVFHFENECIDARRCSKAGGFYFRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 67757 - protein, 221 aa, Homo sapiens
  Payload ID: 13521
  Gene Symbol: PSMD13
  Gene Name: proteasome 26S subunit, non-ATPase 13
  ENSP ID: ENSP00000433115
  MOD_RES (1)..(1): Any amino acid
XNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEIKGMKDRLEFWCTDVKSMEMLVEHQAHDILT

SEQ ID NO: 67758 - protein, 263 aa, Homo sapiens
  Payload ID: 13521
  Gene Symbol: PSMD13
  Gene Name: proteasome 26S subunit, non-ATPase 13
  ENSP ID: ENSP00000433364
MKDVPGFLQQSQNSGPGQPAVWHRLEELYTKKVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAK

SEQ ID NO: 67759 - protein, 70 aa, Homo sapiens
  Payload ID: 13521
  Gene Symbol: PSMD13
  Gene Name: proteasome 26S subunit, non-ATPase 13
  ENSP ID: ENSP00000434587
MKDVPGFLQQSQNSGPGQPAVWHRLEELYTKKLWHQLTLQVLDFVQDPCFAQGDGLIKLYENFISEFEHR

SEQ ID NO: 67760 - protein, 376 aa, Homo sapiens
  Payload ID: 13521
  Gene Symbol: PSMD13
  Gene Name: proteasome 26S subunit, non-ATPase 13
  Uniprot ID: Q9UNM6
  ENSP ID: ENSP00000436186
MKDVPGFLQQSQNSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 67761 - protein, 113 aa, Homo sapiens
  Payload ID: 13521
  Gene Symbol: PSMD13
  Gene Name: proteasome 26S subunit, non-ATPase 13
  ENSP ID: ENSP00000436795
MKDVPGFLQQSQNSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVIL

SEQ ID NO: 67762 - protein, 377 aa, Homo sapiens
  Payload ID: 13521
  Gene Symbol: PSMD13
  Gene Name: proteasome 26S subunit, non-ATPase 13
  ENSP ID: ENSP00000478756
MKDVPGFLQQSQNSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQVMCIKEGPPGVLVHGVKSMEMLVEHQAHDILT

SEQ ID NO: 67763 - protein, 310 aa, Homo sapiens
  Payload ID: 13522
  Gene Symbol: PSMD14
  Gene Name: proteasome 26S subunit, non-ATPase 14
  Uniprot ID: O00487
  ENSP ID: ENSP00000386541
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 67764 - protein, 84 aa, Homo sapiens
  Payload ID: 13522
  Gene Symbol: PSMD14
  Gene Name: proteasome 26S subunit, non-ATPase 14
  ENSP ID: ENSP00000399311
MDRLLRLGGGMPGLGQGPPTDAPAVDTAEQVYISSLALLKMLKHGRAGVPMEVMGLMLGEFVDDYTVRVIDVFAMPQSGTGVSV

SEQ ID NO: 67765 - protein, 908 aa, Homo sapiens
  Payload ID: 13523
  Gene Symbol: PSMD2
  Gene Name: proteasome 26S subunit, non-ATPase 2
  Uniprot ID: Q13200
  ENSP ID: ENSP00000310129
MEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 67766 - protein, 203 aa, Homo sapiens
  Payload ID: 13523
  Gene Symbol: PSMD2
  Gene Name: proteasome 26S subunit, non-ATPase 2
  ENSP ID: ENSP00000400330
  MOD_RES (1)..(1): Any amino acid
XTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQLRYGEPTLRRAVPLALALISVSNPRLNILDTLSKFSHDADPEVSYNSIFAMGMVGSGTNNARLAAMLRQLAQYHAKDPNNLFMVRLAQGLTH

SEQ ID NO: 67767 - protein, 749 aa, Homo sapiens
  Payload ID: 13523
  Gene Symbol: PSMD2
  Gene Name: proteasome 26S subunit, non-ATPase 2
  Uniprot ID: Q13200
  ENSP ID: ENSP00000402618
MSMSGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 67768 - protein, 143 aa, Homo sapiens
  Payload ID: 13523
  Gene Symbol: PSMD2
  Gene Name: proteasome 26S subunit, non-ATPase 2
  ENSP ID: ENSP00000407259
  MOD_RES (1)..(1): Any amino acid
XGEKDTSLYRPALEELRRQIRSSTTSMTSVPKPLKFLRPHYGKLKEIYENMAPGENKRFAADIISVLAMTMSGERECLKYRLVGSQEELASWGHEYVREVLPLKLCSLNRLGLSVGIWQEKWLRSGRSWMTQRRSSGSLCSLW

SEQ ID NO: 67769 - protein, 59 aa, Homo sapiens
  Payload ID: 13523
  Gene Symbol: PSMD2
  Gene Name: proteasome 26S subunit, non-ATPase 2
  ENSP ID: ENSP00000411494
MEEGGRDKAPVQPQQSPAAAPGGTDEKPSGKERRDAGDKDKEQELVRRDPESRRRRLRG

SEQ ID NO: 67770 - protein, 217 aa, Homo sapiens
  Payload ID: 13523
  Gene Symbol: PSMD2
  Gene Name: proteasome 26S subunit, non-ATPase 2
  ENSP ID: ENSP00000414061
MEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVSCVNYVPEPENSALLRCALGVFRKFSRFPEALRLALMLNDMELVEDIFTSCKDVVVQK

SEQ ID NO: 67771 - protein, 778 aa, Homo sapiens
  Payload ID: 13523
  Gene Symbol: PSMD2
  Gene Name: proteasome 26S subunit, non-ATPase 2
  Uniprot ID: Q13200
  ENSP ID: ENSP00000416028
MTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 67772 - protein, 534 aa, Homo sapiens
  Payload ID: 13524
  Gene Symbol: PSMD3
  Gene Name: proteasome 26S subunit, non-ATPase 3
  Uniprot ID: O43242
  ENSP ID: ENSP00000264639
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 67773 - protein, 86 aa, Homo sapiens
  Payload ID: 13524
  Gene Symbol: PSMD3
  Gene Name: proteasome 26S subunit, non-ATPase 3
  ENSP ID: ENSP00000407410
MKQEGSARRRGADKAKPPPGGGEQEPPPPPAPQDVEMKEETFCSPSWKSPWTQRLIYSSVPAREKLRRHPSCLKWKPISNSSWSSS

SEQ ID NO: 67774 - protein, 117 aa, Homo sapiens
  Payload ID: 13524
  Gene Symbol: PSMD3
  Gene Name: proteasome 26S subunit, non-ATPase 3
  ENSP ID: ENSP00000444980
  MOD_RES (1)..(1): Any amino acid
XRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATSPGRVLASSVGAGGEG

SEQ ID NO: 67775 - protein, 380 aa, Homo sapiens
  Payload ID: 13525
  Gene Symbol: PSMD4
  Gene Name: proteasome 26S subunit, non-ATPase 4
  ENSP ID: ENSP00000357876
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 67776 - protein, 377 aa, Homo sapiens
  Payload ID: 13525
  Gene Symbol: PSMD4
  Gene Name: proteasome 26S subunit, non-ATPase 4
  Uniprot ID: P55036
  ENSP ID: ENSP00000357879
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 67777 - protein, 193 aa, Homo sapiens
  Payload ID: 13525
  Gene Symbol: PSMD4
  Gene Name: proteasome 26S subunit, non-ATPase 4
  ENSP ID: ENSP00000388089
  MOD_RES (1)..(1): Any amino acid
XGSPVEDNEKDLVKLAKRLKKEKVNVDIINFGEEALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 67778 - protein, 84 aa, Homo sapiens
  Payload ID: 13525
  Gene Symbol: PSMD4
  Gene Name: proteasome 26S subunit, non-ATPase 4
  ENSP ID: ENSP00000396633
  MOD_RES (1)..(1): Any amino acid
XIDASSAMDTSEPAKSSINRVLSRPLYLEEDDYDVMQDPEFLQSVLENLPGVDPNNEAIRNAMGSLASQATKDGKKDKKEEDKK

SEQ ID NO: 67779 - protein, 39 aa, Homo sapiens
  Payload ID: 13525
  Gene Symbol: PSMD4
  Gene Name: proteasome 26S subunit, non-ATPase 4
  ENSP ID: ENSP00000406408
  MOD_RES (1)..(1): Any amino acid
XQEEEARRAAAASAAEAGIATTGTEGERGGIRSPGTAGC

SEQ ID NO: 67780 - protein, 203 aa, Homo sapiens
  Payload ID: 13525
  Gene Symbol: PSMD4
  Gene Name: proteasome 26S subunit, non-ATPase 4
  ENSP ID: ENSP00000414499
MRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELAL

SEQ ID NO: 67781 - protein, 504 aa, Homo sapiens
  Payload ID: 13526
  Gene Symbol: PSMD5
  Gene Name: proteasome 26S subunit, non-ATPase 5
  Uniprot ID: Q16401
  ENSP ID: ENSP00000210313
MAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 67782 - protein, 461 aa, Homo sapiens
  Payload ID: 13526
  Gene Symbol: PSMD5
  Gene Name: proteasome 26S subunit, non-ATPase 5
  Uniprot ID: Q16401
  ENSP ID: ENSP00000363011
MAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKALIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 67783 - protein, 113 aa, Homo sapiens
  Payload ID: 13526
  Gene Symbol: PSMD5
  Gene Name: proteasome 26S subunit, non-ATPase 5
  ENSP ID: ENSP00000363030
GKQVLQKTGTRFERLLMRIGHQSKNAPVELKIRCLDAISSLLYLPPEQQTDDLLRMTESWFSSLSRDPLELFRGISSQPFPELHCAALKVFTGRKHLHLEELVGGNQVKNTVE

SEQ ID NO: 67784 - protein, 72 aa, Homo sapiens
  Payload ID: 13526
  Gene Symbol: PSMD5
  Gene Name: proteasome 26S subunit, non-ATPase 5
  ENSP ID: ENSP00000435773
MAAQALALLREVARLEAPLEELRALHSVLQAVPLNELRQQAAELRLGPLFSLLNENHRLEELLKILMLLLRF

SEQ ID NO: 67785 - protein, 72 aa, Homo sapiens; identical to SEQ ID NO: 67784
  Payload ID: 13526
  Gene Symbol: PSMD5
  Gene Name: proteasome 26S subunit, non-ATPase 5
  ENSP ID: ENSP00000487480

SEQ ID NO: 67786 - protein, 389 aa, Homo sapiens
  Payload ID: 13527
  Gene Symbol: PSMD6
  Gene Name: proteasome 26S subunit, non-ATPase 6
  Uniprot ID: Q15008
  ENSP ID: ENSP00000295901
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 67787 - protein, 351 aa, Homo sapiens
  Payload ID: 13527
  Gene Symbol: PSMD6
  Gene Name: proteasome 26S subunit, non-ATPase 6
  Uniprot ID: Q15008
  ENSP ID: ENSP00000377952
MNESNDSTNYDMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 67788 - protein, 144 aa, Homo sapiens
  Payload ID: 13527
  Gene Symbol: PSMD6
  Gene Name: proteasome 26S subunit, non-ATPase 6
  ENSP ID: ENSP00000418303
MPLENLEEEGLPKNPDLRIAQLRFLLSLPEHRGDAAVRDELMAAVRDNNFWNRIRQEQTEDCPPSSPSRDMAPYYEALCKSLDWQIDVDLLNKMKKANEDELKRLDEELEDAEKNLGESEIRDAMMAKAEYLCRIGDKEGALTA

SEQ ID NO: 67789 - protein, 442 aa, Homo sapiens
  Payload ID: 13527
  Gene Symbol: PSMD6
  Gene Name: proteasome 26S subunit, non-ATPase 6
  Uniprot ID: Q15008
  ENSP ID: ENSP00000418695
MPLENLEEEGLPKNPDLRIAQLRFLLSLPEHRGDAAVRDELMAAVRDNNFWNRIRQEQTEDCPPSSPSRGWHCQDWPSRKPPTSIRLCFAKPIIKRHRMPSYMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 67790 - protein, 138 aa, Homo sapiens
  Payload ID: 13527
  Gene Symbol: PSMD6
  Gene Name: proteasome 26S subunit, non-ATPase 6
  ENSP ID: ENSP00000418843
  MOD_RES (1)..(1): Any amino acid
XNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLGNCPGLLLPGDYTAK

SEQ ID NO: 67791 - protein, 226 aa, Homo sapiens
  Payload ID: 13527
  Gene Symbol: PSMD6
  Gene Name: proteasome 26S subunit, non-ATPase 6
  ENSP ID: ENSP00000418887
MPLENLEEEDFWNRIRQEQTEDCPPSSPSRGWHCQDWPSRKPPTSIRLCFAKPIIKRHRMPSYMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYE

SEQ ID NO: 67792 - protein, 350 aa, Homo sapiens
  Payload ID: 13527
  Gene Symbol: PSMD6
  Gene Name: proteasome 26S subunit, non-ATPase 6
  Uniprot ID: Q15008
  ENSP ID: ENSP00000419227
MPLENLEEEDMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 67793 - protein, 324 aa, Homo sapiens
  Payload ID: 13528
  Gene Symbol: PSMD7
  Gene Name: proteasome 26S subunit, non-ATPase 7
  Uniprot ID: P51665
  ENSP ID: ENSP00000219313
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKKEGQEKEESKKDRKEDKEKDKDKEKSDVKKEEKKEKK

SEQ ID NO: 67794 - protein, 177 aa, Homo sapiens
  Payload ID: 13528
  Gene Symbol: PSMD7
  Gene Name: proteasome 26S subunit, non-ATPase 7
  ENSP ID: ENSP00000454999
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLR

SEQ ID NO: 67795 - protein, 43 aa, Homo sapiens
  Payload ID: 13528
  Gene Symbol: PSMD7
  Gene Name: proteasome 26S subunit, non-ATPase 7
  ENSP ID: ENSP00000455953
MPELAVQKVVVHPLVLLSVVDHFNRVSPCCPRCPCSSQTPELK

SEQ ID NO: 67796 - protein, 198 aa, Homo sapiens
  Payload ID: 13528
  Gene Symbol: PSMD7
  Gene Name: proteasome 26S subunit, non-ATPase 7
  ENSP ID: ENSP00000457244
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRCRTSSTCCQMSACRSSSRPFT

SEQ ID NO: 67797 - protein, 350 aa, Homo sapiens
  Payload ID: 13529
  Gene Symbol: PSMD8
  Gene Name: proteasome 26S subunit, non-ATPase 8
  Uniprot ID: P48556
  ENSP ID: ENSP00000215071
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 67798 - protein, 172 aa, Homo sapiens
  Payload ID: 13529
  Gene Symbol: PSMD8
  Gene Name: proteasome 26S subunit, non-ATPase 8
  ENSP ID: ENSP00000465107
MAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKVAGVQGKGPWDQGVKSLTTVWGGLEGHWNKTAQV

SEQ ID NO: 67799 - protein, 250 aa, Homo sapiens
  Payload ID: 13529
  Gene Symbol: PSMD8
  Gene Name: proteasome 26S subunit, non-ATPase 8
  ENSP ID: ENSP00000465287
MAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKVAGVQGKG

SEQ ID NO: 67800 - protein, 63 aa, Homo sapiens
  Payload ID: 13529
  Gene Symbol: PSMD8
  Gene Name: proteasome 26S subunit, non-ATPase 8
  ENSP ID: ENSP00000465418
YLMEGSYNKVFLAKGNIPAESYTFFIDILLDTISELGLVMGLWITALISPPLAVDMCGHVCQT

SEQ ID NO: 67801 - protein, 129 aa, Homo sapiens
  Payload ID: 13529
  Gene Symbol: PSMD8
  Gene Name: proteasome 26S subunit, non-ATPase 8
  ENSP ID: ENSP00000467146
MAAAAVNGAAGFSSSGPAATSGAVLQAATGMYEQLKGEWNRKSPNLSKCGEELGRLKLVLLELNFLPTTGTKLTKQQLILARECHWGEIGLGAVAPAHQGGSSHLGSLWEAEVGGSPEVRSSRPAWSTW

SEQ ID NO: 67802 - protein, 67 aa, Homo sapiens
  Payload ID: 13529
  Gene Symbol: PSMD8
  Gene Name: proteasome 26S subunit, non-ATPase 8
  ENSP ID: ENSP00000468445
MAQLKCYYFDYKEQLPESAYMHQLLGLNLLFLLSQNRVAEFHTELERLPAKDIQTNVYIKHPVSLEQ

SEQ ID NO: 67803 - protein, 287 aa, Homo sapiens
  Payload ID: 13529
  Gene Symbol: PSMD8
  Gene Name: proteasome 26S subunit, non-ATPase 8
  ENSP ID: ENSP00000473312
MAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 67804 - protein, 350 aa, Homo sapiens; identical to SEQ ID NO: 67797
  Payload ID: 13529
  Gene Symbol: PSMD8
  Gene Name: proteasome 26S subunit, non-ATPase 8
  Uniprot ID: P48556
  ENSP ID: ENSP00000481136

SEQ ID NO: 67805 - protein, 222 aa, Homo sapiens
  Payload ID: 13530
  Gene Symbol: PSMD9
  Gene Name: proteasome 26S subunit, non-ATPase 9
  ENSP ID: ENSP00000261817
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGPLNVTVIRRGEKHQLRLVPTRWAGKGLLGCNIIPLQR

SEQ ID NO: 67806 - protein, 223 aa, Homo sapiens
  Payload ID: 13530
  Gene Symbol: PSMD9
  Gene Name: proteasome 26S subunit, non-ATPase 9
  Uniprot ID: O00233
  ENSP ID: ENSP00000440485
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGKPLNVTVIRRGEKHQLRLVPTRWAGKGLLGCNIIPLQR

SEQ ID NO: 67807 - protein, 179 aa, Homo sapiens
  Payload ID: 13530
  Gene Symbol: PSMD9
  Gene Name: proteasome 26S subunit, non-ATPase 9
  ENSP ID: ENSP00000440500
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAVIQGLATQVHAQGTRVCKWMMRLWSSAL

SEQ ID NO: 67808 - protein, 85 aa, Homo sapiens
  Payload ID: 13530
  Gene Symbol: PSMD9
  Gene Name: proteasome 26S subunit, non-ATPase 9
  ENSP ID: ENSP00000442210
MSDEEARQSGGSSQAGVVTVSDVQELMRRKEEIEAQIKANYDVLESQKGIGMNEPLVDCEGYPRSDVDLYQVRTARHNIIWSASG

SEQ ID NO: 67809 - protein, 153 aa, Homo sapiens
  Payload ID: 13530
  Gene Symbol: PSMD9
  Gene Name: proteasome 26S subunit, non-ATPase 9
  ENSP ID: ENSP00000443081
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAVI

SEQ ID NO: 67810 - protein, 118 aa, Homo sapiens
  Payload ID: 13530
  Gene Symbol: PSMD9
  Gene Name: proteasome 26S subunit, non-ATPase 9
  Uniprot ID: O00233
  ENSP ID: ENSP00000443772
MSDEEARQSGGSSQAGVVTVSDVQELMRRKEEIEAQIKANYDVLESGLQVDDEIVEFGSVNTQNFQSLHNIGSVVQHSEGKPLNVTVIRRGEKHQLRLVPTRWAGKGLLGCNIIPLQR

SEQ ID NO: 67811 - protein, 128 aa, Homo sapiens
  Payload ID: 13530
  Gene Symbol: PSMD9
  Gene Name: proteasome 26S subunit, non-ATPase 9
  ENSP ID: ENSP00000443968
MNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAVIQGLATQVHAQGTRVCKWMMRLWSSAL

SEQ ID NO: 67812 - protein, 209 aa, Homo sapiens
  Payload ID: 13530
  Gene Symbol: PSMD9
  Gene Name: proteasome 26S subunit, non-ATPase 9
  Uniprot ID: O00233
  ENSP ID: ENSP00000445058
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGALAPTILLSVSMNLTTPGTSSRSP

SEQ ID NO: 67813 - protein, 249 aa, Homo sapiens
  Payload ID: 13531
  Gene Symbol: PSME1
  Gene Name: proteasome activator subunit 1
  Uniprot ID: Q06323
  ENSP ID: ENSP00000206451
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 67814 - protein, 250 aa, Homo sapiens
  Payload ID: 13531
  Gene Symbol: PSME1
  Gene Name: proteasome activator subunit 1
  Uniprot ID: Q06323
  ENSP ID: ENSP00000372155
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYVRRQGQGRGGQRQLSQATHSLTLQARG

SEQ ID NO: 67815 - protein, 90 aa, Homo sapiens
  Payload ID: 13531
  Gene Symbol: PSME1
  Gene Name: proteasome activator subunit 1
  ENSP ID: ENSP00000452843
MTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 67816 - protein, 114 aa, Homo sapiens
  Payload ID: 13531
  Gene Symbol: PSME1
  Gene Name: proteasome activator subunit 1
  ENSP ID: ENSP00000453340
KEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVVG

SEQ ID NO: 67817 - protein, 233 aa, Homo sapiens
  Payload ID: 13531
  Gene Symbol: PSME1
  Gene Name: proteasome activator subunit 1
  Uniprot ID: Q06323
  ENSP ID: ENSP00000453976
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYVRRLCYMTSS

SEQ ID NO: 67818 - protein, 239 aa, Homo sapiens
  Payload ID: 13532
  Gene Symbol: PSME2
  Gene Name: proteasome activator subunit 2
  Uniprot ID: Q9UL46
  ENSP ID: ENSP00000216802
MAKPCGVRLSGEARKQVEVFRQNLFQEAEEFLYRFLPQKIIYLNQLLQEDSLNVADLTSLRAPLDIPIPDPPPKDDEMETDKQEKKEVHKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 67819 - protein, 85 aa, Homo sapiens
  Payload ID: 13532
  Gene Symbol: PSME2
  Gene Name: proteasome activator subunit 2
  ENSP ID: ENSP00000452940
METDKQEKKEVHKCGFLPGNEKVLSLLALVKPEVWTLKEKCILVITWIQHLIPKIEDGNDFGVAIQEKVLERVNAVKTKVEAFQT

SEQ ID NO: 67820 - protein, 48 aa, Homo sapiens
  Payload ID: 13532
  Gene Symbol: PSME2
  Gene Name: proteasome activator subunit 2
  ENSP ID: ENSP00000453161
MAKPCGVRLSGEARKQVEVFRQNLFQEILATENHIPESALARGLPQCG

SEQ ID NO: 67821 - protein, 39 aa, Homo sapiens
  Payload ID: 13532
  Gene Symbol: PSME2
  Gene Name: proteasome activator subunit 2
  ENSP ID: ENSP00000453195
MAKPCGVRLSGEARKQVEVFRQNLFQEVFSFLICKSWTQ

SEQ ID NO: 67822 - protein, 228 aa, Homo sapiens
  Payload ID: 13532
  Gene Symbol: PSME2
  Gene Name: proteasome activator subunit 2
  ENSP ID: ENSP00000453487
MAKPCGVRLSGEARKQAEEFLYRFLPQKIIYLNQLLQEDSLNVADLTSLRAPLDIPIPDPPPKDDEMETDKQEKKEVHKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 67823 - protein, 254 aa, Homo sapiens
  Payload ID: 13532
  Gene Symbol: PSME2
  Gene Name: proteasome activator subunit 2
  ENSP ID: ENSP00000484569
MAKPCGVRLSGEARKQVEVFRQNLFQEAEEFLYRFLPQKIIYLNQLLQEDSLNVADLTSLRAPLDIPIPDPPPKDDEMETDKQEKKEGKRDKRKGLNPLFLTVHKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 67824 - protein, 39 aa, Homo sapiens; identical to SEQ ID NO: 67821
  Payload ID: 13532
  Gene Symbol: PSME2
  Gene Name: proteasome activator subunit 2
  ENSP ID: ENSP00000485798

SEQ ID NO: 67825 - protein, 267 aa, Homo sapiens
  Payload ID: 13533
  Gene Symbol: PSME3
  Gene Name: proteasome activator subunit 3
  Uniprot ID: P61289
  ENSP ID: ENSP00000293362
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTPSGKGPHICFDLQVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67826 - protein, 265 aa, Homo sapiens
  Payload ID: 13533
  Gene Symbol: PSME3
  Gene Name: proteasome activator subunit 3
  Uniprot ID: P61289
  ENSP ID: ENSP00000409487
MEKWILKKIKYLQSGGLSASYYSYKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67827 - protein, 130 aa, Homo sapiens
  Payload ID: 13533
  Gene Symbol: PSME3
  Gene Name: proteasome activator subunit 3
  ENSP ID: ENSP00000437924
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGQNVGTAPDSQDRRWKQLWGVHSGGNSCRAKNC

SEQ ID NO: 67828 - protein, 231 aa, Homo sapiens
  Payload ID: 13533
  Gene Symbol: PSME3
  Gene Name: proteasome activator subunit 3
  ENSP ID: ENSP00000438237
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67829 - protein, 193 aa, Homo sapiens
  Payload ID: 13533
  Gene Symbol: PSME3
  Gene Name: proteasome activator subunit 3
  ENSP ID: ENSP00000441682
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67830 - protein, 42 aa, Homo sapiens
  Payload ID: 13533
  Gene Symbol: PSME3
  Gene Name: proteasome activator subunit 3
  ENSP ID: ENSP00000465155
MASLLKVDQEVKLKTASDTGGREGRGRTEETGRCCPQSPAFF

SEQ ID NO: 67831 - protein, 118 aa, Homo sapiens
  Payload ID: 13533
  Gene Symbol: PSME3
  Gene Name: proteasome activator subunit 3
  ENSP ID: ENSP00000465743
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQI

SEQ ID NO: 67832 - protein, 96 aa, Homo sapiens
  Payload ID: 13533
  Gene Symbol: PSME3
  Gene Name: proteasome activator subunit 3
  ENSP ID: ENSP00000466451
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSI

SEQ ID NO: 67833 - protein, 254 aa, Homo sapiens
  Payload ID: 13533
  Gene Symbol: PSME3
  Gene Name: proteasome activator subunit 3
  Uniprot ID: P61289
  ENSP ID: ENSP00000466794
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67834 - protein, 179 aa, Homo sapiens
  Payload ID: 13533
  Gene Symbol: PSME3
  Gene Name: proteasome activator subunit 3
  ENSP ID: ENSP00000466945
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTEETVAELRTVESEAASYLDQISRYYITRAKLVSKIAKYPHVEDY

SEQ ID NO: 67835 - protein, 110 aa, Homo sapiens
  Payload ID: 13533
  Gene Symbol: PSME3
  Gene Name: proteasome activator subunit 3
  ENSP ID: ENSP00000467580
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESE

SEQ ID NO: 67836 - protein, 198 aa, Homo sapiens
  Payload ID: 13533
  Gene Symbol: PSME3
  Gene Name: proteasome activator subunit 3
  ENSP ID: ENSP00000468702
MASLLKVDQEVKLKVDSFRERITSEPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67837 - protein, 170 aa, Homo sapiens
  Payload ID: 13533
  Gene Symbol: PSME3
  Gene Name: proteasome activator subunit 3
  ENSP ID: ENSP00000478159
MASLLKVDQEVKLKVDSFRERITSEAEDLVANFFPKKLLELDSFLKEPILNIHDLTQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 67838 - protein, 571 aa, Homo sapiens
  Payload ID: 13534
  Gene Symbol: PSME4
  Gene Name: proteasome activator subunit 4
  ENSP ID: ENSP00000374643
MEPAERAGVGEPPEPGGRPEPGPRGFVPQKEIVYNKLLPYAERLDAESDLQLAQIKCNLGRAVQLQELWPGGLFWTRKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRWPFRRFLIFLLHIYLKQE

SEQ ID NO: 67839 - protein, 1843 aa, Homo sapiens
  Payload ID: 13534
  Gene Symbol: PSME4
  Gene Name: proteasome activator subunit 4
  Uniprot ID: Q14997
  ENSP ID: ENSP00000384211
MEPAERAGVGEPPEPGGRPEPGPRGFVPQKEIVYNKLLPYAERLDAESDLQLAQIKCNLGRAVQLQELWPGGLFWTRKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 67840 - protein, 263 aa, Homo sapiens
  Payload ID: 13535
  Gene Symbol: PSMF1
  Gene Name: proteasome inhibitor subunit 1
  ENSP ID: ENSP00000246015
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPRPDRRGQ

SEQ ID NO: 67841 - protein, 271 aa, Homo sapiens
  Payload ID: 13535
  Gene Symbol: PSMF1
  Gene Name: proteasome inhibitor subunit 1
  Uniprot ID: Q92530
  ENSP ID: ENSP00000327704
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 67842 - protein, 271 aa, Homo sapiens; identical to SEQ ID NO: 67841
  Payload ID: 13535
  Gene Symbol: PSMF1
  Gene Name: proteasome inhibitor subunit 1
  Uniprot ID: Q92530
  ENSP ID: ENSP00000338039

SEQ ID NO: 67843 - protein, 127 aa, Homo sapiens
  Payload ID: 13535
  Gene Symbol: PSMF1
  Gene Name: proteasome inhibitor subunit 1
  ENSP ID: ENSP00000371323
HPHTSRQPPWCDPLGPFVVGGEDLDPFGPRRGGMIVDPLRSGFPRALIDPSSGLPNRLPPGAVPPGARFDPFGPIGTSPPGAGVKMSPAKCLEYQIHGDVSSLGNTRQPQRQLWSESCRFREDTVTS

SEQ ID NO: 67844 - protein, 183 aa, Homo sapiens
  Payload ID: 13535
  Gene Symbol: PSMF1
  Gene Name: proteasome inhibitor subunit 1
  ENSP ID: ENSP00000371324
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPP

SEQ ID NO: 67845 - protein, 107 aa, Homo sapiens
  Payload ID: 13535
  Gene Symbol: PSMF1
  Gene Name: proteasome inhibitor subunit 1
  ENSP ID: ENSP00000396547
  MOD_RES (1)..(1): Any amino acid
XIHEQWEKANVSSPHREFPPATAREVDPLRIPPHHPHTSRQPPWPRRGGMIVDPLRSGFPRALIDPSSGLPNRLPPGAVPPGARFDPFGPIGTSPPGPNPDHLPPPG

SEQ ID NO: 67846 - protein, 141 aa, Homo sapiens
  Payload ID: 13536
  Gene Symbol: POMP
  Gene Name: proteasome maturation protein
  Uniprot ID: Q9Y244
  ENSP ID: ENSP00000370222
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 67847 - protein, 263 aa, Homo sapiens
  Payload ID: 13537
  Gene Symbol: PSMA1
  Gene Name: proteasome subunit alpha 1
  Uniprot ID: P25786
  ENSP ID: ENSP00000379676
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 67848 - protein, 269 aa, Homo sapiens
  Payload ID: 13537
  Gene Symbol: PSMA1
  Gene Name: proteasome subunit alpha 1
  Uniprot ID: P25786
  ENSP ID: ENSP00000414359
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 67849 - protein, 2 aa, Homo sapiens
  Payload ID: 13537
  Gene Symbol: PSMA1
  Gene Name: proteasome subunit alpha 1
  ENSP ID: ENSP00000439080
ME

SEQ ID NO: 67850 - protein, 14 aa, Homo sapiens
  Payload ID: 13537
  Gene Symbol: PSMA1
  Gene Name: proteasome subunit alpha 1
  ENSP ID: ENSP00000439724
MEAVKQGSATVGLK

SEQ ID NO: 67851 - protein, 238 aa, Homo sapiens
  Payload ID: 13537
  Gene Symbol: PSMA1
  Gene Name: proteasome subunit alpha 1
  ENSP ID: ENSP00000441166
MEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 67852 - protein, 234 aa, Homo sapiens
  Payload ID: 13538
  Gene Symbol: PSMA2
  Gene Name: proteasome subunit alpha 2
  Uniprot ID: P25787
  ENSP ID: ENSP00000223321
MAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 67853 - protein, 22 aa, Homo sapiens
  Payload ID: 13538
  Gene Symbol: PSMA2
  Gene Name: proteasome subunit alpha 2
  ENSP ID: ENSP00000401954
MAERGYSFSLTTFSCKWCGISN

SEQ ID NO: 67854 - protein, 164 aa, Homo sapiens
  Payload ID: 13538
  Gene Symbol: PSMA2
  Gene Name: proteasome subunit alpha 2
  ENSP ID: ENSP00000404858
MAERGYSFSLTTFRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 67855 - protein, 18 aa, Homo sapiens
  Payload ID: 13538
  Gene Symbol: PSMA2
  Gene Name: proteasome subunit alpha 2
  ENSP ID: ENSP00000410750
  MOD_RES (1)..(1): Any amino acid
XERGYSFSLTTFSFLQMN

SEQ ID NO: 67856 - protein, 36 aa, Homo sapiens
  Payload ID: 13538
  Gene Symbol: PSMA2
  Gene Name: proteasome subunit alpha 2
  ENSP ID: ENSP00000414832
LSPSGKLVQIEYALAAVAGGAPSVGIKECLCTELEN

SEQ ID NO: 67857 - protein, 255 aa, Homo sapiens
  Payload ID: 13539
  Gene Symbol: PSMA3
  Gene Name: proteasome subunit alpha 3
  Uniprot ID: P25788
  ENSP ID: ENSP00000216455
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 67858 - protein, 248 aa, Homo sapiens
  Payload ID: 13539
  Gene Symbol: PSMA3
  Gene Name: proteasome subunit alpha 3
  Uniprot ID: P25788
  ENSP ID: ENSP00000390491
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 67859 - protein, 83 aa, Homo sapiens
  Payload ID: 13539
  Gene Symbol: PSMA3
  Gene Name: proteasome subunit alpha 3
  ENSP ID: ENSP00000450573
HLADRVAMYVHAYTLYSAVRPFGCRIYIVHDEVKDKAFELELSWVGELTNGRHEIVPKDIREEAEKYAKESLKEEDESDDDNM

SEQ ID NO: 67860 - protein, 36 aa, Homo sapiens
  Payload ID: 13539
  Gene Symbol: PSMA3
  Gene Name: proteasome subunit alpha 3
  ENSP ID: ENSP00000451461
MSSIGTGYDLSASTFSPDGRVFQVEYAMKAVENSRQ

SEQ ID NO: 67861 - protein, 180 aa, Homo sapiens
  Payload ID: 13539
  Gene Symbol: PSMA3
  Gene Name: proteasome subunit alpha 3
  ENSP ID: ENSP00000452056
MAVAGLLADARSLADIAREEASNFRSNFGYNIPLKHLADRVAMYVHAYTLYSAVRPFGCSFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 67862 - protein, 54 aa, Homo sapiens
  Payload ID: 13539
  Gene Symbol: PSMA3
  Gene Name: proteasome subunit alpha 3
  ENSP ID: ENSP00000452437
MSSIGTGYDLSASTFSPDGRVFQVEYAMKAVENSSYWNQMQRWCCLWGRKISPF

SEQ ID NO: 67863 - protein, 261 aa, Homo sapiens
  Payload ID: 13540
  Gene Symbol: PSMA4
  Gene Name: proteasome subunit alpha 4
  Uniprot ID: P25789
  ENSP ID: ENSP00000044462
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 67864 - protein, 190 aa, Homo sapiens
  Payload ID: 13540
  Gene Symbol: PSMA4
  Gene Name: proteasome subunit alpha 4
  Uniprot ID: P25789
  ENSP ID: ENSP00000402118
MACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 67865 - protein, 122 aa, Homo sapiens
  Payload ID: 13540
  Gene Symbol: PSMA4
  Gene Name: proteasome subunit alpha 4
  ENSP ID: ENSP00000452917
MCPSLYPRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEK

SEQ ID NO: 67866 - protein, 181 aa, Homo sapiens
  Payload ID: 13540
  Gene Symbol: PSMA4
  Gene Name: proteasome subunit alpha 4
  ENSP ID: ENSP00000452936
MEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSK

SEQ ID NO: 67867 - protein, 236 aa, Homo sapiens
  Payload ID: 13540
  Gene Symbol: PSMA4
  Gene Name: proteasome subunit alpha 4
  ENSP ID: ENSP00000453080
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQL

SEQ ID NO: 67868 - protein, 174 aa, Homo sapiens
  Payload ID: 13540
  Gene Symbol: PSMA4
  Gene Name: proteasome subunit alpha 4
  ENSP ID: ENSP00000453145
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAWKLQH

SEQ ID NO: 67869 - protein, 125 aa, Homo sapiens
  Payload ID: 13540
  Gene Symbol: PSMA4
  Gene Name: proteasome subunit alpha 4
  ENSP ID: ENSP00000453323
MSRRYDSRTTIFSPEGRLYQVEYAMEAIGHAGTCLGILANDGVLLAAERRNIHKLLDEVFFSEKIYKLNEDMACSVAGITSDANVLTNELRLIAQSGNCNTNKREWKDSNQSSQTKRSGAVDQKT

SEQ ID NO: 67870 - protein, 209 aa, Homo sapiens
  Payload ID: 13540
  Gene Symbol: PSMA4
  Gene Name: proteasome subunit alpha 4
  ENSP ID: ENSP00000453523
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAE

SEQ ID NO: 67871 - protein, 183 aa, Homo sapiens
  Payload ID: 13540
  Gene Symbol: PSMA4
  Gene Name: proteasome subunit alpha 4
  ENSP ID: ENSP00000453621
MSRRYDSRTTIFSPEGRLYQVEYAMEAIGHAGTCLGILANDGVLLAAERRNIHKLLDEVFFSEKIYKLNEYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAE

SEQ ID NO: 67872 - protein, 86 aa, Homo sapiens
  Payload ID: 13540
  Gene Symbol: PSMA4
  Gene Name: proteasome subunit alpha 4
  ENSP ID: ENSP00000453758
MCPSLYPRYLLQYQEPIPCEQLVTALCDIKQAYTQFGGKRPFGVSLLYIGWDKHYGFQLYQSDPSGNYGGWKATCIGNNSAWKLQH

SEQ ID NO: 67873 - protein, 220 aa, Homo sapiens
  Payload ID: 13540
  Gene Symbol: PSMA4
  Gene Name: proteasome subunit alpha 4
  ENSP ID: ENSP00000453802
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTREN

SEQ ID NO: 67874 - protein, 230 aa, Homo sapiens
  Payload ID: 13540
  Gene Symbol: PSMA4
  Gene Name: proteasome subunit alpha 4
  ENSP ID: ENSP00000453829
MSRRYDSRTTIFSPEAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 67875 - protein, 261 aa, Homo sapiens; identical to SEQ ID NO: 67863
  Payload ID: 13540
  Gene Symbol: PSMA4
  Gene Name: proteasome subunit alpha 4
  Uniprot ID: P25789
  ENSP ID: ENSP00000453887

SEQ ID NO: 67876 - protein, 241 aa, Homo sapiens
  Payload ID: 13541
  Gene Symbol: PSMA5
  Gene Name: proteasome subunit alpha 5
  Uniprot ID: P28066
  ENSP ID: ENSP00000271308
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 67877 - protein, 183 aa, Homo sapiens
  Payload ID: 13541
  Gene Symbol: PSMA5
  Gene Name: proteasome subunit alpha 5
  Uniprot ID: P28066
  ENSP ID: ENSP00000440618
MEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 67878 - protein, 246 aa, Homo sapiens
  Payload ID: 13542
  Gene Symbol: PSMA6
  Gene Name: proteasome subunit alpha 6
  Uniprot ID: P60900
  ENSP ID: ENSP00000261479
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 67879 - protein, 227 aa, Homo sapiens
  Payload ID: 13542
  Gene Symbol: PSMA6
  Gene Name: proteasome subunit alpha 6
  Uniprot ID: P60900
  ENSP ID: ENSP00000444844
MAGLRREYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 67880 - protein, 203 aa, Homo sapiens
  Payload ID: 13542
  Gene Symbol: PSMA6
  Gene Name: proteasome subunit alpha 6
  ENSP ID: ENSP00000450528
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVEDSYRSRD

SEQ ID NO: 67881 - protein, 67 aa, Homo sapiens
  Payload ID: 13542
  Gene Symbol: PSMA6
  Gene Name: proteasome subunit alpha 6
  ENSP ID: ENSP00000450844
MSRGSSAGFDRHITIFSPEGRLYQVAWTSVVNSTQALEACYIPDTASPRRYKCECYTLFYTEAHSLE

SEQ ID NO: 67882 - protein, 85 aa, Homo sapiens
  Payload ID: 13542
  Gene Symbol: PSMA6
  Gene Name: proteasome subunit alpha 6
  ENSP ID: ENSP00000451171
  MOD_RES (1)..(1): Any amino acid
XRIADISQVYTQNAEMRPLGCCMILIGIDEEQGPQTAITCLSTVLSIDFKPSEIEVGVVTVENPKFRILTEAEIDAHLVALAERD

SEQ ID NO: 67883 - protein, 148 aa, Homo sapiens
  Payload ID: 13542
  Gene Symbol: PSMA6
  Gene Name: proteasome subunit alpha 6
  ENSP ID: ENSP00000451254
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCYCNYMPVYCSIN

SEQ ID NO: 67884 - protein, 107 aa, Homo sapiens
  Payload ID: 13542
  Gene Symbol: PSMA6
  Gene Name: proteasome subunit alpha 6
  ENSP ID: ENSP00000451432
MSRGSSAGFDRHITIFSPEGRLYQVEYAFKAINQGGLTSVAVRGKDCAVIVTQKKVPDKLLDSSTVTHLFKITENIGCVMTGMTVSLCRPGCSASWVQAILVPQPPR

SEQ ID NO: 67885 - protein, 41 aa, Homo sapiens
  Payload ID: 13542
  Gene Symbol: PSMA6
  Gene Name: proteasome subunit alpha 6
  ENSP ID: ENSP00000451958
MSRGSSAGFDRHITIFSPEGRLYQVGQIIGFQHSDSLIQDN

SEQ ID NO: 67886 - protein, 167 aa, Homo sapiens
  Payload ID: 13542
  Gene Symbol: PSMA6
  Gene Name: proteasome subunit alpha 6
  Uniprot ID: P60900
  ENSP ID: ENSP00000452566
MTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 67887 - protein, 252 aa, Homo sapiens
  Payload ID: 13542
  Gene Symbol: PSMA6
  Gene Name: proteasome subunit alpha 6
  ENSP ID: ENSP00000452603
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCWSFLFLGMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 67888 - protein, 167 aa, Homo sapiens; identical to SEQ ID NO: 67886
  Payload ID: 13542
  Gene Symbol: PSMA6
  Gene Name: proteasome subunit alpha 6
  Uniprot ID: P60900
  ENSP ID: ENSP00000479620

SEQ ID NO: 67889 - protein, 67 aa, Homo sapiens; identical to SEQ ID NO: 67881
  Payload ID: 13542
  Gene Symbol: PSMA6
  Gene Name: proteasome subunit alpha 6
  ENSP ID: ENSP00000485776

SEQ ID NO: 67890 - protein, 107 aa, Homo sapiens; identical to SEQ ID NO: 67884
  Payload ID: 13542
  Gene Symbol: PSMA6
  Gene Name: proteasome subunit alpha 6
  ENSP ID: ENSP00000485817

SEQ ID NO: 67891 - protein, 149 aa, Homo sapiens
  Payload ID: 13543
  Gene Symbol: PSMA7
  Gene Name: proteasome subunit alpha 7
  Uniprot ID: O14818
  ENSP ID: ENSP00000359895
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQVGACPLACSPLAAGQSRLRHGGSCHVTSGESEN

SEQ ID NO: 67892 - protein, 178 aa, Homo sapiens
  Payload ID: 13543
  Gene Symbol: PSMA7
  Gene Name: proteasome subunit alpha 7
  Uniprot ID: O14818
  ENSP ID: ENSP00000359898
MAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 67893 - protein, 248 aa, Homo sapiens
  Payload ID: 13543
  Gene Symbol: PSMA7
  Gene Name: proteasome subunit alpha 7
  Uniprot ID: O14818
  ENSP ID: ENSP00000359910
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 67894 - protein, 187 aa, Homo sapiens
  Payload ID: 13543
  Gene Symbol: PSMA7
  Gene Name: proteasome subunit alpha 7
  ENSP ID: ENSP00000397047
  MOD_RES (1)..(1): Any amino acid
XLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEGKVVNAPVFCPFKVVQSGGKNIELAVMRRDQSLKILNPEEIEKYVAEIEKEKEENEKKKQKKAS

SEQ ID NO: 67895 - protein, 256 aa, Homo sapiens
  Payload ID: 13544
  Gene Symbol: PSMA8
  Gene Name: proteasome subunit alpha 8
  Uniprot ID: Q8TAA3
  ENSP ID: ENSP00000311121
MASRYDRAITVFSPDGHLFQVEYAQEAVKKGSTAVGIRGTNIVVLGVEKKSVAKLQDERTVRKICALDDHVCMAFAVLTIFIGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 67896 - protein, 212 aa, Homo sapiens
  Payload ID: 13544
  Gene Symbol: PSMA8
  Gene Name: proteasome subunit alpha 8
  Uniprot ID: Q8TAA3
  ENSP ID: ENSP00000345584
MASRYDRAITVFSPDGHLFQVEYAQEAVKKGSTAVGIRGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 67897 - protein, 250 aa, Homo sapiens
  Payload ID: 13544
  Gene Symbol: PSMA8
  Gene Name: proteasome subunit alpha 8
  Uniprot ID: Q8TAA3
  ENSP ID: ENSP00000409284
MASRYDRAITVFSPDGHLFQVEYAQEAVKKGSTAVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 67898 - protein, 63 aa, Homo sapiens
  Payload ID: 13544
  Gene Symbol: PSMA8
  Gene Name: proteasome subunit alpha 8
  ENSP ID: ENSP00000440327
MASRYDRAITVFSPDGHLFQVEYAQEAVKKGSTAYHVSLIVHDSCGLAWMSAHLKKSEFEVPI

SEQ ID NO: 67899 - protein, 224 aa, Homo sapiens
  Payload ID: 13544
  Gene Symbol: PSMA8
  Gene Name: proteasome subunit alpha 8
  ENSP ID: ENSP00000482057
MDVCTFEKVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 67900 - protein, 241 aa, Homo sapiens
  Payload ID: 13545
  Gene Symbol: PSMB1
  Gene Name: proteasome subunit beta 1
  Uniprot ID: P20618
  ENSP ID: ENSP00000262193
MLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQVGFKNMQNVEHVPLSLDRAMRLVKDVFISAAERDVYTGDALRICIVTKEGIREETVSLRKD

SEQ ID NO: 67901 - protein, 273 aa, Homo sapiens
  Payload ID: 13546
  Gene Symbol: PSMB10
  Gene Name: proteasome subunit beta 10
  Uniprot ID: P40306
  ENSP ID: ENSP00000351314
MLKPALEPRGGFSFENCQRNASLERVLPGLKVPHARKTGTTIAGLVFQDGVILGADTRATNDSVVADKSCEKIHFIAPKIYCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 67902 - protein, 138 aa, Homo sapiens
  Payload ID: 13546
  Gene Symbol: PSMB10
  Gene Name: proteasome subunit beta 10
  ENSP ID: ENSP00000463811
ILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRGCPSSLPGLAATTLCLEPQLS

SEQ ID NO: 67903 - protein, 201 aa, Homo sapiens
  Payload ID: 13547
  Gene Symbol: PSMB2
  Gene Name: proteasome subunit beta 2
  Uniprot ID: P49721
  ENSP ID: ENSP00000362334
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 67904 - protein, 84 aa, Homo sapiens
  Payload ID: 13547
  Gene Symbol: PSMB2
  Gene Name: proteasome subunit beta 2
  ENSP ID: ENSP00000479706
MDYLAALAKAPFAAHGYGAFLTLSILDRYYTPTISRERAVELLRKCLEELQKRFILNLPTFSVRIIDKNGIHDLDNISFPKQGS

SEQ ID NO: 67905 - protein, 145 aa, Homo sapiens
  Payload ID: 13548
  Gene Symbol: PSMB3
  Gene Name: proteasome subunit beta 3
  ENSP ID: ENSP00000478737
MSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYG

SEQ ID NO: 67906 - protein, 107 aa, Homo sapiens
  Payload ID: 13548
  Gene Symbol: PSMB3
  Gene Name: proteasome subunit beta 3
  ENSP ID: ENSP00000481215
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRPHRLPHGD

SEQ ID NO: 67907 - protein, 112 aa, Homo sapiens
  Payload ID: 13548
  Gene Symbol: PSMB3
  Gene Name: proteasome subunit beta 3
  ENSP ID: ENSP00000481442
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRIRITCLKPSPKPC

SEQ ID NO: 67908 - protein, 205 aa, Homo sapiens
  Payload ID: 13548
  Gene Symbol: PSMB3
  Gene Name: proteasome subunit beta 3
  Uniprot ID: P49720
  ENSP ID: ENSP00000483688
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 67909 - protein, 205 aa, Homo sapiens; identical to SEQ ID NO: 67908
  Payload ID: 13548
  Gene Symbol: PSMB3
  Gene Name: proteasome subunit beta 3
  Uniprot ID: P49720
  ENSP ID: ENSP00000483956

SEQ ID NO: 67910 - protein, 145 aa, Homo sapiens; identical to SEQ ID NO: 67905
  Payload ID: 13548
  Gene Symbol: PSMB3
  Gene Name: proteasome subunit beta 3
  ENSP ID: ENSP00000487711

SEQ ID NO: 67911 - protein, 107 aa, Homo sapiens; identical to SEQ ID NO: 67906
  Payload ID: 13548
  Gene Symbol: PSMB3
  Gene Name: proteasome subunit beta 3
  ENSP ID: ENSP00000487856

SEQ ID NO: 67912 - protein, 112 aa, Homo sapiens; identical to SEQ ID NO: 67907
  Payload ID: 13548
  Gene Symbol: PSMB3
  Gene Name: proteasome subunit beta 3
  ENSP ID: ENSP00000488173

SEQ ID NO: 67913 - protein, 264 aa, Homo sapiens
  Payload ID: 13549
  Gene Symbol: PSMB4
  Gene Name: proteasome subunit beta 4
  Uniprot ID: P28070
  ENSP ID: ENSP00000290541
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYRDARSYNRFQIATVTEKGVEIEGPLSTETNWDIAHMISGFE

SEQ ID NO: 67914 - protein, 77 aa, Homo sapiens
  Payload ID: 13550
  Gene Symbol: PSMB5
  Gene Name: proteasome subunit beta 5
  ENSP ID: ENSP00000334973
MALASVLERPLPVNQRGFFGLGGRADLLDLGPGSLSDGLSLAAPGWGVPEEPGIEMLHGTTTLAFKVWSQPPCQAEY

SEQ ID NO: 67915 - protein, 263 aa, Homo sapiens
  Payload ID: 13550
  Gene Symbol: PSMB5
  Gene Name: proteasome subunit beta 5
  Uniprot ID: P28074
  ENSP ID: ENSP00000355325
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 67916 - protein, 160 aa, Homo sapiens
  Payload ID: 13550
  Gene Symbol: PSMB5
  Gene Name: proteasome subunit beta 5
  Uniprot ID: P28074
  ENSP ID: ENSP00000395206
MAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 67917 - protein, 84 aa, Homo sapiens
  Payload ID: 13550
  Gene Symbol: PSMB5
  Gene Name: proteasome subunit beta 5
  ENSP ID: ENSP00000451286
MALASVLERPLPVNQRGFFGLGGRADLLDLGPGSLSDGLSLAAPGWGVPEEPGIEMLHGTTTLAFKASTTWTVKGTGFQGPPSL

SEQ ID NO: 67918 - protein, 118 aa, Homo sapiens
  Payload ID: 13550
  Gene Symbol: PSMB5
  Gene Name: proteasome subunit beta 5
  ENSP ID: ENSP00000451816
  MOD_RES (1)..(1): Any amino acid
XGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPG

SEQ ID NO: 67919 - protein, 203 aa, Homo sapiens
  Payload ID: 13550
  Gene Symbol: PSMB5
  Gene Name: proteasome subunit beta 5
  Uniprot ID: P28074
  ENSP ID: ENSP00000452424
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPVSEVLCLKPKSFGMYLFCGCAERIGNMARPLLRGQ

SEQ ID NO: 67920 - protein, 239 aa, Homo sapiens
  Payload ID: 13551
  Gene Symbol: PSMB6
  Gene Name: proteasome subunit beta 6
  Uniprot ID: P28072
  ENSP ID: ENSP00000270586
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 67921 - protein, 102 aa, Homo sapiens
  Payload ID: 13551
  Gene Symbol: PSMB6
  Gene Name: proteasome subunit beta 6
  ENSP ID: ENSP00000460811
TLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSSQPL

SEQ ID NO: 67922 - protein, 213 aa, Homo sapiens
  Payload ID: 13551
  Gene Symbol: PSMB6
  Gene Name: proteasome subunit beta 6
  ENSP ID: ENSP00000485006
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANAFFFYPQLSLWPWSGMAPVEE

SEQ ID NO: 67923 - protein, 277 aa, Homo sapiens
  Payload ID: 13552
  Gene Symbol: PSMB7
  Gene Name: proteasome subunit beta 7
  Uniprot ID: Q99436
  ENSP ID: ENSP00000259457
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRYQGYIGAALVLGGVDVTGPHLYSIYPHGSTDKLPYVTMGSGSLAAMAVFEDKFRPDMEEEEAKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 67924 - protein, 210 aa, Homo sapiens
  Payload ID: 13552
  Gene Symbol: PSMB7
  Gene Name: proteasome subunit beta 7
  ENSP ID: ENSP00000393157
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRYQGYIGAALVLGGVDVTGPHLYSIYPHGSTDKLPYVTMVHCEEELFTENLFFIRQAEVVSEEAWGPSFAISLAVFLVA

SEQ ID NO: 67925 - protein, 272 aa, Homo sapiens
  Payload ID: 13553
  Gene Symbol: PSMB8
  Gene Name: proteasome subunit beta 8
  Uniprot ID: P28062
  ENSP ID: ENSP00000364015
MLIGTPTPRDTTPSSWLTSSLLVEAAPLDDTTLPTPVSSGCPGLEPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 67926 - protein, 276 aa, Homo sapiens
  Payload ID: 13553
  Gene Symbol: PSMB8
  Gene Name: proteasome subunit beta 8
  Uniprot ID: P28062
  ENSP ID: ENSP00000364016
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 67927 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000372723

SEQ ID NO: 67928 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000372725

SEQ ID NO: 67929 - protein, 252 aa, Homo sapiens
  Payload ID: 13553
  Gene Symbol: PSMB8
  Gene Name: proteasome subunit beta 8
  ENSP ID: ENSP00000378748
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYINCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 67930 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000382538

SEQ ID NO: 67931 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000392693

SEQ ID NO: 67932 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000394090

SEQ ID NO: 67933 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000394155

SEQ ID NO: 67934 - protein, 252 aa, Homo sapiens
  Payload ID: 13553
  Gene Symbol: PSMB8
  Gene Name: proteasome subunit beta 8
  ENSP ID: ENSP00000396430
MALLDVCGAPRGQRPESALPVAGSGRRSDPGHYSFSMRSPELALPRGMKPTEFFQSLGGDGERNVQIEMAHGTTTLAFKFQHGVIAAVDSRASAGSYINCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 67935 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000397057

SEQ ID NO: 67936 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000401868

SEQ ID NO: 67937 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000402406

SEQ ID NO: 67938 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000404585

SEQ ID NO: 67939 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000404615

SEQ ID NO: 67940 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000406797

SEQ ID NO: 67941 - protein, 276 aa, Homo sapiens
  Payload ID: 13553
  Gene Symbol: PSMB8
  Gene Name: proteasome subunit beta 8
  ENSP ID: ENSP00000406878
MALLDVCGAPRGQRPESALPVAGSGRRSDPGHYSFSMRSPELALPRGMKPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 67942 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000406913

SEQ ID NO: 67943 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000407539

SEQ ID NO: 67944 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000408825

SEQ ID NO: 67945 - protein, 252 aa, Homo sapiens; identical to SEQ ID NO: 67929
  Payload ID: 13553
  Gene Symbol: PSMB8
  Gene Name: proteasome subunit beta 8
  ENSP ID: ENSP00000410205

SEQ ID NO: 67946 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000412618

SEQ ID NO: 67947 - protein, 272 aa, Homo sapiens; identical to SEQ ID NO: 67925
  Payload ID: 13553
  Gene Symbol: PSMB8
  Gene Name: proteasome subunit beta 8
  Uniprot ID: P28062
  ENSP ID: ENSP00000414731

SEQ ID NO: 67948 - protein, 276 aa, Homo sapiens; identical to SEQ ID NO: 67926
  Payload ID: 13553
  Gene Symbol: PSMB8
  Gene Name: proteasome subunit beta 8
  Uniprot ID: P28062
  ENSP ID: ENSP00000414770

SEQ ID NO: 67949 - protein, 219 aa, Homo sapiens
  Payload ID: 13554
  Gene Symbol: PSMB9
  Gene Name: proteasome subunit beta 9
  Uniprot ID: P28065
  ENSP ID: ENSP00000363993
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 67950 - protein, 219 aa, Homo sapiens; identical to SEQ ID NO: 67949
  Payload ID: 13554
  Gene Symbol: PSMB9
  Gene Name: proteasome subunit beta 9
  Uniprot ID: P28065
  ENSP ID: ENSP00000372595

SEQ ID NO: 67951 - protein, 219 aa, Homo sapiens; identical to SEQ ID NO: 67949
  Payload ID: 13554
  Gene Symbol: PSMB9
  Gene Name: proteasome subunit beta 9
  Uniprot ID: P28065
  ENSP ID: ENSP00000372721

SEQ ID NO: 67952 - protein, 196 aa, Homo sapiens
  Payload ID: 13554
  Gene Symbol: PSMB9
  Gene Name: proteasome subunit beta 9
  ENSP ID: ENSP00000378739
MAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 67953 - protein, 196 aa, Homo sapiens; identical to SEQ ID NO: 67952
  Payload ID: 13554
  Gene Symbol: PSMB9
  Gene Name: proteasome subunit beta 9
  ENSP ID: ENSP00000382305

SEQ ID NO: 67954 - protein, 178 aa, Homo sapiens
  Payload ID: 13554
  Gene Symbol: PSMB9
  Gene Name: proteasome subunit beta 9
  ENSP ID: ENSP00000382313
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDATSTKRRVCGYFLRTQKRENQNQRVHEYMCTGERSLSSSPLLSCS

SEQ ID NO: 67955 - protein, 196 aa, Homo sapiens; identical to SEQ ID NO: 67952
  Payload ID: 13554
  Gene Symbol: PSMB9
  Gene Name: proteasome subunit beta 9
  ENSP ID: ENSP00000382516

SEQ ID NO: 67956 - protein, 178 aa, Homo sapiens; identical to SEQ ID NO: 67954
  Payload ID: 13554
  Gene Symbol: PSMB9
  Gene Name: proteasome subunit beta 9
  ENSP ID: ENSP00000382528

SEQ ID NO: 67957 - protein, 178 aa, Homo sapiens; identical to SEQ ID NO: 67954
  Payload ID: 13554
  Gene Symbol: PSMB9
  Gene Name: proteasome subunit beta 9
  ENSP ID: ENSP00000389541

SEQ ID NO: 67958 - protein, 219 aa, Homo sapiens [sequence omitted]

SEQ ID NO: 67959 - protein, 131 aa, Homo sapiens
  Payload ID: 13554
  Gene Symbol: PSMB9
  Gene Name: proteasome subunit beta 9
  ENSP ID: ENSP00000394363
MAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFI

SEQ ID NO: 67960 - protein, 131 aa, Homo sapiens
  Payload ID: 13554
  Gene Symbol: PSMB9
  Gene Name: proteasome subunit beta 9
  ENSP ID: ENSP00000396311
MAVEFDGGVVMGSDSRVSAGEAVVNRVFDKLSPLHEHIYCALSGSAADAQAVADMAAYQLELHGIELEEPPLVLAAANVVRNISYKYREDLSAHLMVAGWDQREGGQVYGTLGGMLTRQPFAIGGSGSTFI

SEQ ID NO: 67961 - protein, 219 aa, Homo sapiens; identical to SEQ ID NO: 67949
  Payload ID: 13554
  Gene Symbol: PSMB9
  Gene Name: proteasome subunit beta 9
  Uniprot ID: P28065
  ENSP ID: ENSP00000396813

SEQ ID NO: 67962 - protein, 196 aa, Homo sapiens
  Payload ID: 13554
  Gene Symbol: PSMB9
  Gene Name: proteasome subunit beta 9
  ENSP ID: ENSP00000398642
MAVEFDGGVVMGSDSRVSAGEAVVNRVFDKLSPLHEHIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 67963 - protein, 196 aa, Homo sapiens; identical to SEQ ID NO: 67952
  Payload ID: 13554
  Gene Symbol: PSMB9
  Gene Name: proteasome subunit beta 9
  ENSP ID: ENSP00000401221

SEQ ID NO: 67964 - protein, 131 aa, Homo sapiens; identical to SEQ ID NO: 67959
  Payload ID: 13554
  Gene Symbol: PSMB9
  Gene Name: proteasome subunit beta 9
  ENSP ID: ENSP00000401229

SEQ ID NO: 67965 - protein, 196 aa, Homo sapiens; identical to SEQ ID NO: 67962
  Payload ID: 13554
  Gene Symbol: PSMB9
  Gene Name: proteasome subunit beta 9
  ENSP ID: ENSP00000401624

SEQ ID NO: 67966 - protein, 178 aa, Homo sapiens
  Payload ID: 13554
  Gene Symbol: PSMB9
  Gene Name: proteasome subunit beta 9
  ENSP ID: ENSP00000403857
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDATSTKRRVCGYFLRTQKRENQNQRVHEYMCTSERSLSSSPLLSCS

SEQ ID NO: 67967 - protein, 196 aa, Homo sapiens; identical to SEQ ID NO: 67952
  Payload ID: 13554
  Gene Symbol: PSMB9
  Gene Name: proteasome subunit beta 9
  ENSP ID: ENSP00000404847

SEQ ID NO: 67968 - protein, 131 aa, Homo sapiens; identical to SEQ ID NO: 67960
  Payload ID: 13554
  Gene Symbol: PSMB9
  Gene Name: proteasome subunit beta 9
  ENSP ID: ENSP00000406077

SEQ ID NO: 67969 - protein, 196 aa, Homo sapiens; identical to SEQ ID NO: 67962
  Payload ID: 13554
  Gene Symbol: PSMB9
  Gene Name: proteasome subunit beta 9
  ENSP ID: ENSP00000406380

SEQ ID NO: 67970 - protein, 131 aa, Homo sapiens; identical to SEQ ID NO: 67959
  Payload ID: 13554
  Gene Symbol: PSMB9
  Gene Name: proteasome subunit beta 9
  ENSP ID: ENSP00000406858

SEQ ID NO: 67971 - protein, 219 aa, Homo sapiens; identical to SEQ ID NO: 67949
  Payload ID: 13554
  Gene Symbol: PSMB9
  Gene Name: proteasome subunit beta 9
  Uniprot ID: P28065
  ENSP ID: ENSP00000407233

SEQ ID NO: 67972 - protein, 219 aa, Homo sapiens [sequence omitted]

SEQ ID NO: 67973 - protein, 178 aa, Homo sapiens; identical to SEQ ID NO: 67954
  Payload ID: 13554
  Gene Symbol: PSMB9
  Gene Name: proteasome subunit beta 9
  ENSP ID: ENSP00000408178

SEQ ID NO: 67974 - protein, 131 aa, Homo sapiens; identical to SEQ ID NO: 67959
  Payload ID: 13554
  Gene Symbol: PSMB9
  Gene Name: proteasome subunit beta 9
  ENSP ID: ENSP00000408447

SEQ ID NO: 67975 - protein, 178 aa, Homo sapiens; identical to SEQ ID NO: 67966
  Payload ID: 13554
  Gene Symbol: PSMB9
  Gene Name: proteasome subunit beta 9
  ENSP ID: ENSP00000409785

SEQ ID NO: 67976 - protein, 131 aa, Homo sapiens; identical to SEQ ID NO: 67960
  Payload ID: 13554
  Gene Symbol: PSMB9
  Gene Name: proteasome subunit beta 9
  ENSP ID: ENSP00000409850

SEQ ID NO: 67977 - protein, 131 aa, Homo sapiens; identical to SEQ ID NO: 67959
  Payload ID: 13554
  Gene Symbol: PSMB9
  Gene Name: proteasome subunit beta 9
  ENSP ID: ENSP00000411561

SEQ ID NO: 67978 - protein, 219 aa, Homo sapiens [sequence omitted]

SEQ ID NO: 67979 - protein, 178 aa, Homo sapiens; identical to SEQ ID NO: 67966
  Payload ID: 13554
  Gene Symbol: PSMB9
  Gene Name: proteasome subunit beta 9
  ENSP ID: ENSP00000413194

SEQ ID NO: 67980 - protein, 634 aa, Homo sapiens
  Payload ID: 13555
  Gene Symbol: POT1
  Gene Name: protection of telomeres 1
  Uniprot ID: Q9NUX5
  ENSP ID: ENSP00000350249
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 67981 - protein, 503 aa, Homo sapiens
  Payload ID: 13555
  Gene Symbol: POT1
  Gene Name: protection of telomeres 1
  ENSP ID: ENSP00000377002
MVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 67982 - protein, 82 aa, Homo sapiens
  Payload ID: 13555
  Gene Symbol: POT1
  Gene Name: protection of telomeres 1
  ENSP ID: ENSP00000388921
MSLVPATNYIYTPLNQLKGGTIVNVYGVVKFFKPPYLSKGTDYCSVVTIVDQTNVKLTCLLFSGNYEALPIIYKNGDIVRFH

SEQ ID NO: 67983 - protein, 85 aa, Homo sapiens
  Payload ID: 13555
  Gene Symbol: POT1
  Gene Name: protection of telomeres 1
  ENSP ID: ENSP00000397632
  MOD_RES (1)..(1): Any amino acid
XGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 67984 - protein, 45 aa, Homo sapiens
  Payload ID: 13555
  Gene Symbol: POT1
  Gene Name: protection of telomeres 1
  ENSP ID: ENSP00000403088
MSLVPATNYIYTPLNQLKGGTIVNVYGVVKFFKPPYLSKGTDSSI

SEQ ID NO: 67985 - protein, 138 aa, Homo sapiens
  Payload ID: 13555
  Gene Symbol: POT1
  Gene Name: protection of telomeres 1
  ENSP ID: ENSP00000416820
  MOD_RES (1)..(1): Any amino acid
XCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDEALNLEE

SEQ ID NO: 67986 - protein, 77 aa, Homo sapiens
  Payload ID: 13555
  Gene Symbol: POT1
  Gene Name: protection of telomeres 1
  ENSP ID: ENSP00000476290
KAEVDGASFLLKVWDGTRTPFPSWRVLIQDLVLEGDLSHIHRLQNLTIDILVYDNHVHVARSLKVMYSRKKCYFMFL

SEQ ID NO: 67987 - protein, 340 aa, Homo sapiens
  Payload ID: 13555
  Gene Symbol: POT1
  Gene Name: protection of telomeres 1
  ENSP ID: ENSP00000476371
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPNGVSLRPPGWSSVARSRLIAASTS

SEQ ID NO: 67988 - protein, 518 aa, Homo sapiens
  Payload ID: 13555
  Gene Symbol: POT1
  Gene Name: protection of telomeres 1
  ENSP ID: ENSP00000476506
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGTGYCTPPICVCYDLYT

SEQ ID NO: 67989 - protein, 119 aa, Homo sapiens
  Payload ID: 13555
  Gene Symbol: POT1
  Gene Name: protection of telomeres 1
  ENSP ID: ENSP00000476673
  MOD_RES (1)..(1): Any amino acid
XEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSKDNL

SEQ ID NO: 67990 - protein, 580 aa, Homo sapiens
  Payload ID: 13555
  Gene Symbol: POT1
  Gene Name: protection of telomeres 1
  ENSP ID: ENSP00000476981
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSVSIRGQILPDSSIRSSDG

SEQ ID NO: 67991 - protein, 73 aa, Homo sapiens
  Payload ID: 13555
  Gene Symbol: POT1
  Gene Name: protection of telomeres 1
  ENSP ID: ENSP00000477258
MSLVPATNYIYTPLNQLKGGTIVNVYGVVKFFKPPYLSKGTDYCSVVTIVDQTNVKLTCLLFSGNYEALPIIY

SEQ ID NO: 67992 - protein, 86 aa, Homo sapiens
  Payload ID: 13555
  Gene Symbol: POT1
  Gene Name: protection of telomeres 1
  ENSP ID: ENSP00000477320
LHCPKCHLLQEVPHEGDLDIIFQDGATKTPDVKLQNTSLYDSKIWTTKNQKGRKVAVHFVKNNGILPLSNECLLLIEGKIFKSLFC

SEQ ID NO: 67993 - protein, 353 aa, Homo sapiens
  Payload ID: 13556
  Gene Symbol: PRMT1
  Gene Name: protein arginine methyltransferase 1
  Uniprot ID: Q99873
  ENSP ID: ENSP00000375724
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 67994 - protein, 371 aa, Homo sapiens
  Payload ID: 13556
  Gene Symbol: PRMT1
  Gene Name: protein arginine methyltransferase 1
  ENSP ID: ENSP00000406162
MAAAEAANCIMENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 67995 - protein, 207 aa, Homo sapiens
  Payload ID: 13556
  Gene Symbol: PRMT1
  Gene Name: protein arginine methyltransferase 1
  ENSP ID: ENSP00000431957
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIK

SEQ ID NO: 67996 - protein, 54 aa, Homo sapiens
  Payload ID: 13556
  Gene Symbol: PRMT1
  Gene Name: protein arginine methyltransferase 1
  ENSP ID: ENSP00000432050
MAAAEAANCIMENFVATLANGMSLQPPLEEVTPFALPCVCPHFPSPPLPSCGLS

SEQ ID NO: 67997 - protein, 160 aa, Homo sapiens
  Payload ID: 13556
  Gene Symbol: PRMT1
  Gene Name: protein arginine methyltransferase 1
  ENSP ID: ENSP00000432349
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDR

SEQ ID NO: 67998 - protein, 205 aa, Homo sapiens
  Payload ID: 13556
  Gene Symbol: PRMT1
  Gene Name: protein arginine methyltransferase 1
  ENSP ID: ENSP00000432538
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACL

SEQ ID NO: 67999 - protein, 160 aa, Homo sapiens; identical to SEQ ID NO: 67997
  Payload ID: 13556
  Gene Symbol: PRMT1
  Gene Name: protein arginine methyltransferase 1
  ENSP ID: ENSP00000432788

SEQ ID NO: 68000 - protein, 238 aa, Homo sapiens
  Payload ID: 13556
  Gene Symbol: PRMT1
  Gene Name: protein arginine methyltransferase 1
  ENSP ID: ENSP00000433480
  MOD_RES (1)..(1): Any amino acid
XAANCIMEVSAWSAAVGGRRLWNFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIK

SEQ ID NO: 68001 - protein, 325 aa, Homo sapiens
  Payload ID: 13556
  Gene Symbol: PRMT1
  Gene Name: protein arginine methyltransferase 1
  ENSP ID: ENSP00000433556
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 68002 - protein, 63 aa, Homo sapiens
  Payload ID: 13556
  Gene Symbol: PRMT1
  Gene Name: protein arginine methyltransferase 1
  ENSP ID: ENSP00000434911
MVGVAEVSCGQAESSEKPNAEDMTSKDYYFDSYAHFGIHEEMLKDEVRTLTYRNSMFHNRHLF

SEQ ID NO: 68003 - protein, 110 aa, Homo sapiens
  Payload ID: 13556
  Gene Symbol: PRMT1
  Gene Name: protein arginine methyltransferase 1
  ENSP ID: ENSP00000437273
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANK

SEQ ID NO: 68004 - protein, 285 aa, Homo sapiens
  Payload ID: 13556
  Gene Symbol: PRMT1
  Gene Name: protein arginine methyltransferase 1
  ENSP ID: ENSP00000484505
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 68005 - protein, 228 aa, Homo sapiens
  Payload ID: 13557
  Gene Symbol: PRMT2
  Gene Name: protein arginine methyltransferase 2
  Uniprot ID: P55345
  ENSP ID: ENSP00000291705
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLVGEKVFPIWR

SEQ ID NO: 68006 - protein, 284 aa, Homo sapiens
  Payload ID: 13557
  Gene Symbol: PRMT2
  Gene Name: protein arginine methyltransferase 2
  Uniprot ID: P55345
  ENSP ID: ENSP00000335490
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLAAPLLSCRILPCTCASGPLHVLLACCLPLPCTCASVPLHVLLACCLPVLRAPQPSGLHLSWPIFLL

SEQ ID NO: 68007 - protein, 433 aa, Homo sapiens
  Payload ID: 13557
  Gene Symbol: PRMT2
  Gene Name: protein arginine methyltransferase 2
  Uniprot ID: P55345
  ENSP ID: ENSP00000347906
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 68008 - protein, 253 aa, Homo sapiens
  Payload ID: 13557
  Gene Symbol: PRMT2
  Gene Name: protein arginine methyltransferase 2
  ENSP ID: ENSP00000380752
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLVRAGVRAAGGRSWGASEHGLGWANLRISRVVRDSF

SEQ ID NO: 68009 - protein, 433 aa, Homo sapiens; identical to SEQ ID NO: 68007
  Payload ID: 13557
  Gene Symbol: PRMT2
  Gene Name: protein arginine methyltransferase 2
  Uniprot ID: P55345
  ENSP ID: ENSP00000380759

SEQ ID NO: 68010 - protein, 433 aa, Homo sapiens; identical to SEQ ID NO: 68007
  Payload ID: 13557
  Gene Symbol: PRMT2
  Gene Name: protein arginine methyltransferase 2
  Uniprot ID: P55345
  ENSP ID: ENSP00000380760

SEQ ID NO: 68011 - protein, 331 aa, Homo sapiens
  Payload ID: 13557
  Gene Symbol: PRMT2
  Gene Name: protein arginine methyltransferase 2
  Uniprot ID: P55345
  ENSP ID: ENSP00000397266
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLTLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 68012 - protein, 194 aa, Homo sapiens
  Payload ID: 13557
  Gene Symbol: PRMT2
  Gene Name: protein arginine methyltransferase 2
  ENSP ID: ENSP00000406127
  MOD_RES (1)..(1): Any amino acid
XQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLLLQDLACSPEATPRFPRSRLHTQQSPTSQWHCRCRG

SEQ ID NO: 68013 - protein, 301 aa, Homo sapiens
  Payload ID: 13557
  Gene Symbol: PRMT2
  Gene Name: protein arginine methyltransferase 2
  Uniprot ID: P55345
  ENSP ID: ENSP00000407463
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLHHTLEADAVHDGRPSPCPYRRRGHGFSCVAEKPSVEKAHVCGSELGCHFQTRPHISKSWRKSLPHLEMTVDALFGKQCAYLEG

SEQ ID NO: 68014 - protein, 289 aa, Homo sapiens
  Payload ID: 13557
  Gene Symbol: PRMT2
  Gene Name: protein arginine methyltransferase 2
  Uniprot ID: P55345
  ENSP ID: ENSP00000411984
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKLEKKSSPSGDDS

SEQ ID NO: 68015 - protein, 161 aa, Homo sapiens
  Payload ID: 13557
  Gene Symbol: PRMT2
  Gene Name: protein arginine methyltransferase 2
  ENSP ID: ENSP00000482158
MLADQPRTTKYHSVILQNKESLRIKSSWTWAVGLGSSVSSVHTMRGLERVYAVEASEMAQHTGQLVLQNGFADIITVYQQKVEDVVLPEKVDVLVSEWMGTCLLFEFMIESILYARDAWLKETGSFGPPWLRCTLCPAVLIRIIVARCSSGTTRTSSTSAL

SEQ ID NO: 68016 - protein, 46 aa, Homo sapiens
  Payload ID: 13558
  Gene Symbol: PRMT3
  Gene Name: protein arginine methyltransferase 3
  ENSP ID: ENSP00000329586
MCSLASGATGYSHLLKKHFHTVSLSISLILTAWFINMDLNFMDTLS

SEQ ID NO: 68017 - protein, 531 aa, Homo sapiens
  Payload ID: 13558
  Gene Symbol: PRMT3
  Gene Name: protein arginine methyltransferase 3
  Uniprot ID: O60678
  ENSP ID: ENSP00000331879
MCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 68018 - protein, 469 aa, Homo sapiens
  Payload ID: 13558
  Gene Symbol: PRMT3
  Gene Name: protein arginine methyltransferase 3
  ENSP ID: ENSP00000397766
MCSLASGATGYSHLLKKHFHTVSLSISLILTAWFINMNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 68019 - protein, 54 aa, Homo sapiens
  Payload ID: 13558
  Gene Symbol: PRMT3
  Gene Name: protein arginine methyltransferase 3
  ENSP ID: ENSP00000434260
MCSLASGATGGYPGPSAPGSSSPRPRRCGAGGRPSGTRARAGWGARRDHEGGAE

SEQ ID NO: 68020 - protein, 46 aa, Homo sapiens; identical to SEQ ID NO: 68016
  Payload ID: 13558
  Gene Symbol: PRMT3
  Gene Name: protein arginine methyltransferase 3
  ENSP ID: ENSP00000435151

SEQ ID NO: 68021 - protein, 576 aa, Homo sapiens
  Payload ID: 13559
  Gene Symbol: PRMT5
  Gene Name: protein arginine methyltransferase 5
  Uniprot ID: O14744
  ENSP ID: ENSP00000216350
MRGPNSGTEKGRLVIPEKQGFDFLCMPVFHPRFKREFIQEPAKNRPGPQTRSDLLLSGRAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 68022 - protein, 637 aa, Homo sapiens
  Payload ID: 13559
  Gene Symbol: PRMT5
  Gene Name: protein arginine methyltransferase 5
  Uniprot ID: O14744
  ENSP ID: ENSP00000319169
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 68023 - protein, 466 aa, Homo sapiens
  Payload ID: 13559
  Gene Symbol: PRMT5
  Gene Name: protein arginine methyltransferase 5
  Uniprot ID: O14744
  ENSP ID: ENSP00000380582
MRGPNSGTEKGRLVIPEKQGFDFLCMPVFHPRFKREFIQEPAKNRPGPQTRSDLLLSGRDWNTLIVGKLSPWIRPDSKVEKIRRNSEALEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 68024 - protein, 620 aa, Homo sapiens
  Payload ID: 13559
  Gene Symbol: PRMT5
  Gene Name: protein arginine methyltransferase 5
  Uniprot ID: O14744
  ENSP ID: ENSP00000380583
MRGPNSGTEKGRLVIPEKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 68025 - protein, 179 aa, Homo sapiens
  Payload ID: 13559
  Gene Symbol: PRMT5
  Gene Name: protein arginine methyltransferase 5
  ENSP ID: ENSP00000387663
  MOD_RES (1)..(1): Any amino acid
XDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKPITVREGQTICVRFWRCSNSKKVWYEWAVTAPVCSAIHNPTGRSYTIGL

SEQ ID NO: 68026 - protein, 186 aa, Homo sapiens
  Payload ID: 13559
  Gene Symbol: PRMT5
  Gene Name: protein arginine methyltransferase 5
  ENSP ID: ENSP00000409482
MAAMAVGGAGGSRVSSGRDLNCVPEIADTLGAVAKQGFDFLCMPVFHPRFKREFIQEPAKNRPGPQTRSDLLLSGRVFVFLGWGSADWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHT

SEQ ID NO: 68027 - protein, 86 aa, Homo sapiens
  Payload ID: 13559
  Gene Symbol: PRMT5
  Gene Name: protein arginine methyltransferase 5
  ENSP ID: ENSP00000450633
MAAMAVGGAGGSRVSSGRDLNCVPEIADTLGAVAKQGLEYANCGKAFSMDSSRLKSGEDSQELRGGHVTGAEFWCIFGSSSFPAAP

SEQ ID NO: 68028 - protein, 183 aa, Homo sapiens
  Payload ID: 13559
  Gene Symbol: PRMT5
  Gene Name: protein arginine methyltransferase 5
  ENSP ID: ENSP00000450737
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEALEVQFIITGTNHHSEKEFCSYLQYLEYLSQNRPPPNAYELFAKGYEDYLQSPLQPLMDNLESQTYEVFEKDPIKYSQY

SEQ ID NO: 68029 - protein, 185 aa, Homo sapiens
  Payload ID: 13559
  Gene Symbol: PRMT5
  Gene Name: protein arginine methyltransferase 5
  ENSP ID: ENSP00000450919
MAAMAVGGAGGSRVSSGRDLNCVPEIADTLGAVAKQGADWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLG

SEQ ID NO: 68030 - protein, 138 aa, Homo sapiens
  Payload ID: 13559
  Gene Symbol: PRMT5
  Gene Name: protein arginine methyltransferase 5
  ENSP ID: ENSP00000450956
SQLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLLENWQFE

SEQ ID NO: 68031 - protein, 69 aa, Homo sapiens
  Payload ID: 13559
  Gene Symbol: PRMT5
  Gene Name: protein arginine methyltransferase 5
  ENSP ID: ENSP00000451127
MRGPNSGTEKGRLVIPEKQGLEYANCGKAFSMDSSRLKSGEDSQELRGGHVTGAEFWCIFGSSSFPAAP

SEQ ID NO: 68032 - protein, 177 aa, Homo sapiens
  Payload ID: 13559
  Gene Symbol: PRMT5
  Gene Name: protein arginine methyltransferase 5
  ENSP ID: ENSP00000451245
ENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGISP

SEQ ID NO: 68033 - protein, 42 aa, Homo sapiens
  Payload ID: 13559
  Gene Symbol: PRMT5
  Gene Name: protein arginine methyltransferase 5
  ENSP ID: ENSP00000452102
MAAMAVGGAGGSRVSSGRDLNCVPEIADTLGAVAKQGFPAAP

SEQ ID NO: 68034 - protein, 180 aa, Homo sapiens
  Payload ID: 13559
  Gene Symbol: PRMT5
  Gene Name: protein arginine methyltransferase 5
  ENSP ID: ENSP00000452218
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAFWMRVPLVAPEDLRDDIIENAPTTHTEEYSGEEKTWMWWHNFRTLCDYSKRIAVALEIGADLPSNHVIDRWLGEP

SEQ ID NO: 68035 - protein, 279 aa, Homo sapiens
  Payload ID: 13559
  Gene Symbol: PRMT5
  Gene Name: protein arginine methyltransferase 5
  ENSP ID: ENSP00000452409
RRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYTLEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADR

SEQ ID NO: 68036 - protein, 169 aa, Homo sapiens
  Payload ID: 13559
  Gene Symbol: PRMT5
  Gene Name: protein arginine methyltransferase 5
  ENSP ID: ENSP00000452411
MPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGAD

SEQ ID NO: 68037 - protein, 61 aa, Homo sapiens
  Payload ID: 13559
  Gene Symbol: PRMT5
  Gene Name: protein arginine methyltransferase 5
  ENSP ID: ENSP00000452501
  MOD_RES (1)..(1): Any amino acid
XIRPETHSPGMFSWFPILFPIKQPITVREGQTICVRFWRCSNSKKGSSHQSMKTSGQGVRN

SEQ ID NO: 68038 - protein, 104 aa, Homo sapiens
  Payload ID: 13559
  Gene Symbol: PRMT5
  Gene Name: protein arginine methyltransferase 5
  ENSP ID: ENSP00000452509
MHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEE

SEQ ID NO: 68039 - protein, 593 aa, Homo sapiens
  Payload ID: 13559
  Gene Symbol: PRMT5
  Gene Name: protein arginine methyltransferase 5
  Uniprot ID: O14744
  ENSP ID: ENSP00000452555
MAAMAVGGAGGSRVSSGRDLNCVPEIADTLGAVAKQGFDFLCMPVFHPRFKREFIQEPAKNRPGPQTRSDLLLSGRAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 68040 - protein, 42 aa, Homo sapiens; identical to SEQ ID NO: 68033
  Payload ID: 13559
  Gene Symbol: PRMT5
  Gene Name: protein arginine methyltransferase 5
  ENSP ID: ENSP00000485787

SEQ ID NO: 68041 - protein, 375 aa, Homo sapiens
  Payload ID: 13560
  Gene Symbol: PRMT6
  Gene Name: protein arginine methyltransferase 6
  Uniprot ID: Q96LA8
  ENSP ID: ENSP00000359095
MSQPKKRKLESGGGGEGGEGTEEEDGAEREAALERPRRTKRERDQLYYECYSDVSVHEEMIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 68042 - protein, 692 aa, Homo sapiens
  Payload ID: 13561
  Gene Symbol: PRMT7
  Gene Name: protein arginine methyltransferase 7
  Uniprot ID: Q9NVM4
  ENSP ID: ENSP00000343103
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 68043 - protein, 692 aa, Homo sapiens; identical to SEQ ID NO: 68042
  Payload ID: 13561
  Gene Symbol: PRMT7
  Gene Name: protein arginine methyltransferase 7
  Uniprot ID: Q9NVM4
  ENSP ID: ENSP00000409324

SEQ ID NO: 68044 - protein, 642 aa, Homo sapiens
  Payload ID: 13561
  Gene Symbol: PRMT7
  Gene Name: protein arginine methyltransferase 7
  Uniprot ID: Q9NVM4
  ENSP ID: ENSP00000414716
MKIFCSRANPTTGSVEWLEEDEHYDYHQEIARSSYADMLHDKDRVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 68045 - protein, 567 aa, Homo sapiens
  Payload ID: 13561
  Gene Symbol: PRMT7
  Gene Name: protein arginine methyltransferase 7
  ENSP ID: ENSP00000454776
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRVCREQQDVPLVLAATLPCVLAGGCGRGCSFLTGPVADPEPLW

SEQ ID NO: 68046 - protein, 80 aa, Homo sapiens
  Payload ID: 13561
  Gene Symbol: PRMT7
  Gene Name: protein arginine methyltransferase 7
  ENSP ID: ENSP00000454980
MKIFCSRANPTTGSVEWLEEDEHYDYHQEIARSSYADMLHDKDRNVKYYQGIRAAVSRVKDRGQKALVLDIGTGTGLLSM

SEQ ID NO: 68047 - protein, 223 aa, Homo sapiens
  Payload ID: 13561
  Gene Symbol: PRMT7
  Gene Name: protein arginine methyltransferase 7
  ENSP ID: ENSP00000455538
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAP

SEQ ID NO: 68048 - protein, 33 aa, Homo sapiens
  Payload ID: 13561
  Gene Symbol: PRMT7
  Gene Name: protein arginine methyltransferase 7
  ENSP ID: ENSP00000455705
MKIFCSRANPTTGSVEWLEEDEHYDYHQEIARM

SEQ ID NO: 68049 - protein, 72 aa, Homo sapiens
  Payload ID: 13561
  Gene Symbol: PRMT7
  Gene Name: protein arginine methyltransferase 7
  ENSP ID: ENSP00000456190
MKIFCSRANPTTGSVEWLEEDEHYDYHQEIARSSYADMLHDKDRNVKYYQGIRAAVSRVKDRGQKALVLDIG

SEQ ID NO: 68050 - protein, 108 aa, Homo sapiens
  Payload ID: 13561
  Gene Symbol: PRMT7
  Gene Name: protein arginine methyltransferase 7
  ENSP ID: ENSP00000456364
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVE

SEQ ID NO: 68051 - protein, 169 aa, Homo sapiens
  Payload ID: 13561
  Gene Symbol: PRMT7
  Gene Name: protein arginine methyltransferase 7
  ENSP ID: ENSP00000456848
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEE

SEQ ID NO: 68052 - protein, 33 aa, Homo sapiens; identical to SEQ ID NO: 68048
  Payload ID: 13561
  Gene Symbol: PRMT7
  Gene Name: protein arginine methyltransferase 7
  ENSP ID: ENSP00000457381

SEQ ID NO: 68053 - protein, 394 aa, Homo sapiens
  Payload ID: 13562
  Gene Symbol: PRMT8
  Gene Name: protein arginine methyltransferase 8
  Uniprot ID: Q9NR22
  ENSP ID: ENSP00000372067
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 68054 - protein, 385 aa, Homo sapiens
  Payload ID: 13562
  Gene Symbol: PRMT8
  Gene Name: protein arginine methyltransferase 8
  Uniprot ID: Q9NR22
  ENSP ID: ENSP00000414507
MESLASDGFKLKEVSSVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 68055 - protein, 845 aa, Homo sapiens
  Payload ID: 13563
  Gene Symbol: PRMT9
  Gene Name: protein arginine methyltransferase 9
  Uniprot ID: Q6P2P2
  ENSP ID: ENSP00000314396
MSNSRPRSRRDAGGGAGAAGRDELVSRSLQSAEHCLGVQDFGTAYAHYLLVLSLAPELKHDVKETFQYTLFRWAEELDALSRIQDLLGCYEQALELFPDDEVICNSMGEHLFRMGFRDEAAGYFHKAVKLNPDFSDAKENFYRVANWLVERWHFIMLNDTKRNTIYNAAIQKAVCLGSKSVLDIGAGTGILSMFAKKAGAHSVYACELSKTMYELACDVVAANKMEAGIKLLHTKSLDIEIPKHIPERVSLVVTETVDAGLFGEGIVESLIHAWEHLLLQPKTKGESANCEKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPVIKEGILDAIMVWFVLQLDDEHSLSTSPSEETCWEQAVYPVQDLADYWIKPGDHVMMEVSCQDCYLRIQSISVLGLECEMDVAKSFTQNKDLLSLGNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 68056 - protein, 66 aa, Homo sapiens
  Payload ID: 13563
  Gene Symbol: PRMT9
  Gene Name: protein arginine methyltransferase 9
  ENSP ID: ENSP00000426732
MSNSRPRSRRDAGGGAGAAGRDELVSRSLQSAEHCLGVQDFGTAYAHYLLVLSLAPELKHDVKNGL

SEQ ID NO: 68057 - protein, 770 aa, Homo sapiens
  Payload ID: 13564
  Gene Symbol: PATL1
  Gene Name: protein associated with topoisomerase II homolog 1 (yeast)
  Uniprot ID: Q86TB9
  ENSP ID: ENSP00000300146
MFRYESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALAKPISIPTNLVSLFSRYVDRQKLNLLETKLQLVQGIR

SEQ ID NO: 68058 - protein, 543 aa, Homo sapiens
  Payload ID: 13565
  Gene Symbol: PATL2
  Gene Name: protein associated with topoisomerase II homolog 2 (yeast)
  Uniprot ID: C9JE40
  ENSP ID: ENSP00000416673
MNCLEGPGKTCGPLASEEELVSACQLEKEEENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPSPPAKKPWSQQPDPYANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 68059 - protein, 354 aa, Homo sapiens
  Payload ID: 13565
  Gene Symbol: PATL2
  Gene Name: protein associated with topoisomerase II homolog 2 (yeast)
  ENSP ID: ENSP00000453695
MTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 68060 - protein, 158 aa, Homo sapiens
  Payload ID: 13565
  Gene Symbol: PATL2
  Gene Name: protein associated with topoisomerase II homolog 2 (yeast)
  ENSP ID: ENSP00000453723
QALQMLFKPLGKCISHLTLHELLQGLQGLTLLPPGSSERPVTVVLQNQDRHGGSDCLGDSPNAYSLSGRTPSFPQQPTSPVLSPRGQTIGSAAGGQDGVCLDLLICLFWNTCMWEVESSDTSYIDYVYRDPESLKTFLMPLYIGEPFPIFISFLQKSK

SEQ ID NO: 68061 - protein, 125 aa, Homo sapiens
  Payload ID: 13565
  Gene Symbol: PATL2
  Gene Name: protein associated with topoisomerase II homolog 2 (yeast)
  ENSP ID: ENSP00000453898
MLGMSLASLHFLWQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQT

SEQ ID NO: 68062 - protein, 543 aa, Homo sapiens; identical to SEQ ID NO: 68058
  Payload ID: 13565
  Gene Symbol: PATL2
  Gene Name: protein associated with topoisomerase II homolog 2 (yeast)
  Uniprot ID: C9JE40
  ENSP ID: ENSP00000453915

SEQ ID NO: 68063 - protein, 188 aa, Homo sapiens
  Payload ID: 13565
  Gene Symbol: PATL2
  Gene Name: protein associated with topoisomerase II homolog 2 (yeast)
  ENSP ID: ENSP00000454201
  MOD_RES (1)..(1): Any amino acid
XENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQTPMLTS

SEQ ID NO: 68064 - protein, 461 aa, Homo sapiens
  Payload ID: 13566
  Gene Symbol: PROC
  Gene Name: protein C (inactivator of coagulation factors Va and VIIIa)
  Uniprot ID: P04070
  ENSP ID: ENSP00000234071
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 68065 - protein, 236 aa, Homo sapiens
  Payload ID: 13566
  Gene Symbol: PROC
  Gene Name: protein C (inactivator of coagulation factors Va and VIIIa)
  ENSP ID: ENSP00000384225
  MOD_RES (1)..(1): Any amino acid
XCSLDNGGCTHYCLEEVGWRRCSCAPGYKLGDDLLQCHPAGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 68066 - protein, 495 aa, Homo sapiens
  Payload ID: 13566
  Gene Symbol: PROC
  Gene Name: protein C (inactivator of coagulation factors Va and VIIIa)
  ENSP ID: ENSP00000386679
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 68067 - protein, 52 aa, Homo sapiens
  Payload ID: 13566
  Gene Symbol: PROC
  Gene Name: protein C (inactivator of coagulation factors Va and VIIIa)
  ENSP ID: ENSP00000391220
MWQLTSLLLFVATWGISGTPAPLGAADPQTCQLLPGGAPSQQPGAGVHRGDL

SEQ ID NO: 68068 - protein, 52 aa, Homo sapiens; identical to SEQ ID NO: 68067
  Payload ID: 13566
  Gene Symbol: PROC
  Gene Name: protein C (inactivator of coagulation factors Va and VIIIa)
  ENSP ID: ENSP00000392606

SEQ ID NO: 68069 - protein, 116 aa, Homo sapiens
  Payload ID: 13566
  Gene Symbol: PROC
  Gene Name: protein C (inactivator of coagulation factors Va and VIIIa)
  ENSP ID: ENSP00000406295
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIG

SEQ ID NO: 68070 - protein, 175 aa, Homo sapiens
  Payload ID: 13566
  Gene Symbol: PROC
  Gene Name: protein C (inactivator of coagulation factors Va and VIIIa)
  ENSP ID: ENSP00000411241
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREEVGWRRCSCAPGYKLGDDLLQCHPAVKFPCGRPWKRMEKKR

SEQ ID NO: 68071 - protein, 126 aa, Homo sapiens
  Payload ID: 13566
  Gene Symbol: PROC
  Gene Name: protein C (inactivator of coagulation factors Va and VIIIa)
  ENSP ID: ENSP00000412697
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGW

SEQ ID NO: 68072 - protein, 238 aa, Homo sapiens
  Payload ID: 13567
  Gene Symbol: PROCR
  Gene Name: protein C receptor, endothelial
  Uniprot ID: Q9UNN8
  ENSP ID: ENSP00000216968
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 68073 - protein, 213 aa, Homo sapiens
  Payload ID: 13567
  Gene Symbol: PROCR
  Gene Name: protein C receptor, endothelial
  ENSP ID: ENSP00000489117
  MOD_RES (1)..(1): Any amino acid
XYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKDNGVGAGSLWPILQRQTESPEAFKRYNQINKSSTIKIQHSILPDLY

SEQ ID NO: 68074 - protein, 34 aa, Homo sapiens
  Payload ID: 13567
  Gene Symbol: PROCR
  Gene Name: protein C receptor, endothelial
  ENSP ID: ENSP00000489456
AYNRTRYELREFLEDTCVQYVQKHISAENTKDLY

SEQ ID NO: 68075 - protein, 525 aa, Homo sapiens
  Payload ID: 13568
  Gene Symbol: PDIA2
  Gene Name: protein disulfide isomerase family A, member 2
  Uniprot ID: Q13087
  ENSP ID: ENSP00000219406
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 68076 - protein, 522 aa, Homo sapiens
  Payload ID: 13568
  Gene Symbol: PDIA2
  Gene Name: protein disulfide isomerase family A, member 2
  Uniprot ID: Q13087
  ENSP ID: ENSP00000384410
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 68077 - protein, 227 aa, Homo sapiens
  Payload ID: 13568
  Gene Symbol: PDIA2
  Gene Name: protein disulfide isomerase family A, member 2
  ENSP ID: ENSP00000392277
  MOD_RES (1)..(1): Any amino acid
XLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDALDMTFGLTDRPRLFQQFGLTKDTVVLFKKFDEGRADFPVDEELGLDLG

SEQ ID NO: 68078 - protein, 154 aa, Homo sapiens
  Payload ID: 13568
  Gene Symbol: PDIA2
  Gene Name: protein disulfide isomerase family A, member 2
  ENSP ID: ENSP00000405081
AVLNGQVKEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 68079 - protein, 505 aa, Homo sapiens
  Payload ID: 13569
  Gene Symbol: PDIA3
  Gene Name: protein disulfide isomerase family A, member 3
  Uniprot ID: P30101
  ENSP ID: ENSP00000300289
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 68080 - protein, 123 aa, Homo sapiens
  Payload ID: 13569
  Gene Symbol: PDIA3
  Gene Name: protein disulfide isomerase family A, member 3
  ENSP ID: ENSP00000389906
SDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTAGVSSYFVLHISLTSLRTRLWHIQSKK

SEQ ID NO: 68081 - protein, 75 aa, Homo sapiens
  Payload ID: 13569
  Gene Symbol: PDIA3
  Gene Name: protein disulfide isomerase family A, member 3
  ENSP ID: ENSP00000391111
MRLRRLALFPGVALLLAAARLAAASDVLELTDDNFESRISDTGSAGLMLVEFFAPWLQNSPSQRDPSATLWLLKR

SEQ ID NO: 68082 - protein, 71 aa, Homo sapiens
  Payload ID: 13569
  Gene Symbol: PDIA3
  Gene Name: protein disulfide isomerase family A, member 3
  ENSP ID: ENSP00000398005
MRLRRLALFPGVALLLAAARLAAASDVLELTDDNFESRISDTGSAGLMLVEFFAPCSIPAGFEEESLLQPH

SEQ ID NO: 68083 - protein, 645 aa, Homo sapiens
  Payload ID: 13570
  Gene Symbol: PDIA4
  Gene Name: protein disulfide isomerase family A, member 4
  Uniprot ID: P13667
  ENSP ID: ENSP00000286091
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 68084 - protein, 163 aa, Homo sapiens
  Payload ID: 13570
  Gene Symbol: PDIA4
  Gene Name: protein disulfide isomerase family A, member 4
  ENSP ID: ENSP00000408628
MRPRKAFLLLLLLGLVQLLAVAGAEGPDEDFRQVQANSRRTRPGSGKGEGEPLERRGEGVKKQVRVLWNSKHSFSKCDSSNRENAIEDEEEEEEEDDDEEEDDLEVKEENGVLVLNDANFDNFVADKDTVLLEFYAPWCGHCKQFAPEYEKIANILKDKDPPI

SEQ ID NO: 68085 - protein, 519 aa, Homo sapiens
  Payload ID: 13571
  Gene Symbol: PDIA5
  Gene Name: protein disulfide isomerase family A, member 5
  Uniprot ID: Q14554
  ENSP ID: ENSP00000323313
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 68086 - protein, 83 aa, Homo sapiens
  Payload ID: 13571
  Gene Symbol: PDIA5
  Gene Name: protein disulfide isomerase family A, member 5
  ENSP ID: ENSP00000417199
  MOD_RES (1)..(1): Any amino acid
XTLVMFYAPWCPHCKKVIPHFTATADAFKDDRKIACAAVDCVKDKNQDLCQQEAVKGYPTFHYYHYGKFAEKYDSDRTVFSVG

SEQ ID NO: 68087 - protein, 262 aa, Homo sapiens
  Payload ID: 13571
  Gene Symbol: PDIA5
  Gene Name: protein disulfide isomerase family A, member 5
  Uniprot ID: Q14554
  ENSP ID: ENSP00000417520
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKKVWPL

SEQ ID NO: 68088 - protein, 64 aa, Homo sapiens
  Payload ID: 13571
  Gene Symbol: PDIA5
  Gene Name: protein disulfide isomerase family A, member 5
  ENSP ID: ENSP00000419946
MKVDLSPKDKKVELFHYQDGAFHTEYNRAVTFKSIVAFLKDPKGPPLWEEDPGAKDVVHLDSEK

SEQ ID NO: 68089 - protein, 440 aa, Homo sapiens
  Payload ID: 13572
  Gene Symbol: PDIA6
  Gene Name: protein disulfide isomerase family A, member 6
  Uniprot ID: Q15084
  ENSP ID: ENSP00000272227
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 68090 - protein, 445 aa, Homo sapiens
  Payload ID: 13572
  Gene Symbol: PDIA6
  Gene Name: protein disulfide isomerase family A, member 6
  Uniprot ID: Q15084
  ENSP ID: ENSP00000371024
MYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 68091 - protein, 488 aa, Homo sapiens
  Payload ID: 13572
  Gene Symbol: PDIA6
  Gene Name: protein disulfide isomerase family A, member 6
  Uniprot ID: Q15084
  ENSP ID: ENSP00000384459
MRIITAPASKVSRGSNELMILARRSDRGSPTSPAHSLSRKSPIMYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 68092 - protein, 492 aa, Homo sapiens
  Payload ID: 13572
  Gene Symbol: PDIA6
  Gene Name: protein disulfide isomerase family A, member 6
  Uniprot ID: Q15084
  ENSP ID: ENSP00000385385
MRRDLREKLVWVCRPLAPVEVPANISSDFQPCSPTSPAHSLSRKSPIMYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 68093 - protein, 11 aa, Homo sapiens
  Payload ID: 13572
  Gene Symbol: PDIA6
  Gene Name: protein disulfide isomerase family A, member 6
  ENSP ID: ENSP00000389558
MYPSTTMANAP

SEQ ID NO: 68094 - protein, 437 aa, Homo sapiens
  Payload ID: 13572
  Gene Symbol: PDIA6
  Gene Name: protein disulfide isomerase family A, member 6
  Uniprot ID: Q15084
  ENSP ID: ENSP00000438778
MILGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 68095 - protein, 492 aa, Homo sapiens; identical to SEQ ID NO: 68092
  Payload ID: 13572
  Gene Symbol: PDIA6
  Gene Name: protein disulfide isomerase family A, member 6
  Uniprot ID: Q15084
  ENSP ID: ENSP00000481892

SEQ ID NO: 68096 - protein, 584 aa, Homo sapiens
  Payload ID: 13573
  Gene Symbol: PDILT
  Gene Name: protein disulfide isomerase-like, testis expressed
  Uniprot ID: Q8N807
  ENSP ID: ENSP00000305465
MDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFFEGNRSEPISCKGVVESAALVVWLRRQISQKAFLFNSSEQVAEFVISRPLVIVGFFQDLEEEVAELFYDVIKDFPELTFGVITIGNVIGRFHVTLDSVLVFKKGKIVNRQKLINDSTNKQELNRVIKQHLTDFVIEYNTENKDLISELHIMSHMLLFVSKSSESYGIIIQHYKLASKEFQNKILFILVDADEPRNGRVFKYFRVTEVDIPSVQILNLSSDARYKMPSDDITYESLKKFGRSFLSKNATKHQSSEEIPKYWDQGLVKQLVGKNFNVVVFDKEKDVFVMFYAPWSKKCKMLFPLLEELGRKYQNHSTIIIAKIDVTANDIQLMYLDRYPFFRLFPSGSQQAVLYKGEHTLKGFSDFLESHIKTKIEDEDELLSVEQNEVIEEEVLAEEKEVPMMRKGLPEQQSPELENMTKYVSKLEEPAGKKKTSEEVVVVVAKPKGPPVQKKKPKVKEEL

SEQ ID NO: 68097 - protein, 177 aa, Homo sapiens
  Payload ID: 13573
  Gene Symbol: PDILT
  Gene Name: protein disulfide isomerase-like, testis expressed
  ENSP ID: ENSP00000459161
MDLLWMPLLLVAACVSAVHSSPEVNAGVSSIHITKPVHILEERSLLVLTPAGLTQMLNQTRFLMVLFHEVLLLLPRLKYNGAILAHRNLHLPGSSDSPASASQVAGITDNPSSKQSRNLAEELGKAVEIMGKGKNGIGFGKVDITIEKELQQEFGITKAPELKLFFEGNRSEPISCK

SEQ ID NO: 68098 - protein, 300 aa, Homo sapiens
  Payload ID: 13574
  Gene Symbol: PGGT1B
  Gene Name: protein geranylgeranyltransferase type I, beta subunit
  Uniprot ID: P53609
  ENSP ID: ENSP00000368935
MAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 68099 - protein, 377 aa, Homo sapiens
  Payload ID: 13574
  Gene Symbol: PGGT1B
  Gene Name: protein geranylgeranyltransferase type I, beta subunit
  Uniprot ID: P53609
  ENSP ID: ENSP00000404676
MAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 68100 - protein, 651 aa, Homo sapiens
  Payload ID: 13575
  Gene Symbol: PIAS1
  Gene Name: protein inhibitor of activated STAT, 1
  Uniprot ID: O75925
  ENSP ID: ENSP00000249636
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 68101 - protein, 653 aa, Homo sapiens
  Payload ID: 13575
  Gene Symbol: PIAS1
  Gene Name: protein inhibitor of activated STAT, 1
  Uniprot ID: O75925
  ENSP ID: ENSP00000438574
MFTLQDSYVKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 68102 - protein, 64 aa, Homo sapiens
  Payload ID: 13575
  Gene Symbol: PIAS1
  Gene Name: protein inhibitor of activated STAT, 1
  ENSP ID: ENSP00000456558
  MOD_RES (1)..(1): Any amino acid
XILSLPHQASPVSRTPSLPAVDTSYINTSLIQDYRHPFHMTPMPYDLQALQHLLACRCSSSSFR

SEQ ID NO: 68103 - protein, 160 aa, Homo sapiens
  Payload ID: 13575
  Gene Symbol: PIAS1
  Gene Name: protein inhibitor of activated STAT, 1
  ENSP ID: ENSP00000456721
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLAEII

SEQ ID NO: 68104 - protein, 20 aa, Homo sapiens
  Payload ID: 13575
  Gene Symbol: PIAS1
  Gene Name: protein inhibitor of activated STAT, 1
  ENSP ID: ENSP00000457698
MADSAELKEEEWERRSPSAF

SEQ ID NO: 68105 - protein, 572 aa, Homo sapiens
  Payload ID: 13576
  Gene Symbol: PIAS2
  Gene Name: protein inhibitor of activated STAT, 2
  Uniprot ID: O75928
  ENSP ID: ENSP00000317163
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 68106 - protein, 182 aa, Homo sapiens
  Payload ID: 13576
  Gene Symbol: PIAS2
  Gene Name: protein inhibitor of activated STAT, 2
  ENSP ID: ENSP00000381648
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLGIFCQVVGEIIQSKFS

SEQ ID NO: 68107 - protein, 282 aa, Homo sapiens
  Payload ID: 13576
  Gene Symbol: PIAS2
  Gene Name: protein inhibitor of activated STAT, 2
  ENSP ID: ENSP00000443238
MSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 68108 - protein, 122 aa, Homo sapiens
  Payload ID: 13576
  Gene Symbol: PIAS2
  Gene Name: protein inhibitor of activated STAT, 2
  ENSP ID: ENSP00000465312
MVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFE

SEQ ID NO: 68109 - protein, 621 aa, Homo sapiens
  Payload ID: 13576
  Gene Symbol: PIAS2
  Gene Name: protein inhibitor of activated STAT, 2
  Uniprot ID: O75928
  ENSP ID: ENSP00000465676
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQYCPPMFLDSLTSPLTASSTSVTTTSSHESSTHVSSSSSRSETGVITSSGSNIPDIISLD

SEQ ID NO: 68110 - protein, 89 aa, Homo sapiens
  Payload ID: 13576
  Gene Symbol: PIAS2
  Gene Name: protein inhibitor of activated STAT, 2
  ENSP ID: ENSP00000466596
MAVPFYIPTSNVWSDPVSQHPRQHLVLSVFFILAILNMVSSFRVSELQVLLGFAGRNKSGRKHDLLMRALHLLKSGCSPAVQIKIRELY

SEQ ID NO: 68111 - protein, 95 aa, Homo sapiens
  Payload ID: 13576
  Gene Symbol: PIAS2
  Gene Name: protein inhibitor of activated STAT, 2
  ENSP ID: ENSP00000468017
MLSKFHMAVPFYIPTSNVWSDPVSQHPRQHLVLSVFFILAILNMVSSFRVSELQVLLGFAGRNKSGRKHDLLMRALHLLKSGCSPAVQIKIRELY

SEQ ID NO: 68112 - protein, 88 aa, Homo sapiens
  Payload ID: 13576
  Gene Symbol: PIAS2
  Gene Name: protein inhibitor of activated STAT, 2
  ENSP ID: ENSP00000468166
MLPFSQNMVSSFRVSELQVLLGFAGRNKSGRKHDLLMRALHLLKSGCSPAVQIKIRELYRRRYPRTLEGLSDLSTIKSSVFSLDGGSS

SEQ ID NO: 68113 - protein, 536 aa, Homo sapiens
  Payload ID: 13576
  Gene Symbol: PIAS2
  Gene Name: protein inhibitor of activated STAT, 2
  ENSP ID: ENSP00000479025
HMAVPFYIPTSNVWSDPVSQHPRQHLVLSVFFILAILNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGFVNL

SEQ ID NO: 68114 - protein, 593 aa, Homo sapiens
  Payload ID: 13577
  Gene Symbol: PIAS3
  Gene Name: protein inhibitor of activated STAT, 3
  ENSP ID: ENSP00000358304
MAELGELKHMVMSFRVSELQVLLGFAGRNKSGRKHELLAKALHLLKSSCAPSVQMKIKELYRRRFPRKTLGPSDLSLLSLPPGTSPPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 68115 - protein, 628 aa, Homo sapiens
  Payload ID: 13577
  Gene Symbol: PIAS3
  Gene Name: protein inhibitor of activated STAT, 3
  Uniprot ID: Q9Y6X2
  ENSP ID: ENSP00000376765
MAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 68116 - protein, 259 aa, Homo sapiens
  Payload ID: 13577
  Gene Symbol: PIAS3
  Gene Name: protein inhibitor of activated STAT, 3
  ENSP ID: ENSP00000376766
MVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGR

SEQ ID NO: 68117 - protein, 92 aa, Homo sapiens
  Payload ID: 13577
  Gene Symbol: PIAS3
  Gene Name: protein inhibitor of activated STAT, 3
  ENSP ID: ENSP00000476245
MEAGGCMDSEHMVMSFRVSELQVLLGFAGRNKSGRKHELLAKALHLLKSSCAPSVQMKIKELYRRRFPRKTLGPSDLSLLSLPPGTSPVGSP

SEQ ID NO: 68118 - protein, 510 aa, Homo sapiens
  Payload ID: 13578
  Gene Symbol: PIAS4
  Gene Name: protein inhibitor of activated STAT, 4
  Uniprot ID: Q8N2W9
  ENSP ID: ENSP00000262971
MAAELVEAKNMVMSFRVSDLQMLLGFVGRSKSGLKHELVTRALQLVQFDCSPELFKKIKELYETRYAKKNSEPAPQPHRPLDPLTMHSTYDRAGAVPRTPLAGPNIDYPVLYGKYLNGLGRLPAKTLKPEVRLVKLPFFNMLDELLKPTELVPQNNEKLQESPCIFALTPRQVELIRNSRELQPGVKAVQVVLRICYSDTSCPQEDQYPPNIAVKVNHSYCSVPGYYPSNKPGVEPKRPCRPINLTHLMYLSSATNRITVTWGNYGKSYSVALYLVRQLTSSELLQRLKTIGVKHPELCKALVKEKLRLDPDSEIATTGVRVSLICPLVKMRLSVPCRAETCAHLQCFDAVFYLQMNEKKPTWMCPVCDKPAPYDQLIIDGLLSKILSECEDADEIEYLVDGSWCPIRAEKERSCSPQGAILVLGPSDANGLLPAPSVNGSGALGSTGGGGPVGSMENGKPGADVVDLTLDSSSSSEDEEEEEEEEEDEDEEGPRPKRRCPFQKGLVPAC

SEQ ID NO: 68119 - protein, 336 aa, Homo sapiens
  Payload ID: 13579
  Gene Symbol: PROCA1
  Gene Name: protein interacting with cyclin A1
  Uniprot ID: Q8NCQ7
  ENSP ID: ENSP00000301039
MWVRTTLTIERWTKEKTEPKARSWDESRCRGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 68120 - protein, 364 aa, Homo sapiens
  Payload ID: 13579
  Gene Symbol: PROCA1
  Gene Name: protein interacting with cyclin A1
  ENSP ID: ENSP00000411400
MWVRTTLTIERWTKEKTEPKARSWDEALSDVNRLPSWERGHLLAGVASSTDVSTFSEGGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 68121 - protein, 152 aa, Homo sapiens
  Payload ID: 13579
  Gene Symbol: PROCA1
  Gene Name: protein interacting with cyclin A1
  ENSP ID: ENSP00000463898
MWVRTTLTIERWTKEKTEPKARSWDESRCRDVNRLPSWERGHLLAGVASSTDVSTFSEGDCKEPDKCCWRHKQCTGHIIYPFASDCVRHSLHLHSVNHCNCNSSFELVLPAQSQLCTPCSALREMGRRSVGLRQAQRKPTVPQASGSGSLGE

SEQ ID NO: 68122 - protein, 41 aa, Homo sapiens
  Payload ID: 13579
  Gene Symbol: PROCA1
  Gene Name: protein interacting with cyclin A1
  ENSP ID: ENSP00000464600
MWVRTTLTIERWTKEKTEPKARSWDESRCRGAKATDLSLWQ

SEQ ID NO: 68123 - protein, 110 aa, Homo sapiens
  Payload ID: 13579
  Gene Symbol: PROCA1
  Gene Name: protein interacting with cyclin A1
  ENSP ID: ENSP00000468747
MATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRG

SEQ ID NO: 68124 - protein, 415 aa, Homo sapiens
  Payload ID: 13580
  Gene Symbol: PICK1
  Gene Name: protein interacting with PRKCA 1
  Uniprot ID: Q9NRD5
  ENSP ID: ENSP00000349465
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 68125 - protein, 415 aa, Homo sapiens; identical to SEQ ID NO: 68124
  Payload ID: 13580
  Gene Symbol: PICK1
  Gene Name: protein interacting with PRKCA 1
  Uniprot ID: Q9NRD5
  ENSP ID: ENSP00000385205

SEQ ID NO: 68126 - protein, 51 aa, Homo sapiens
  Payload ID: 13580
  Gene Symbol: PICK1
  Gene Name: protein interacting with PRKCA 1
  ENSP ID: ENSP00000387861
MFADLDYDIEEDKLYLTTPQQPWTAQWQLAMRSPVSMAGQSKGKLRWRWRR

SEQ ID NO: 68127 - protein, 134 aa, Homo sapiens
  Payload ID: 13580
  Gene Symbol: PICK1
  Gene Name: protein interacting with PRKCA 1
  ENSP ID: ENSP00000397588
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTA

SEQ ID NO: 68128 - protein, 229 aa, Homo sapiens
  Payload ID: 13580
  Gene Symbol: PICK1
  Gene Name: protein interacting with PRKCA 1
  ENSP ID: ENSP00000398141
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIK

SEQ ID NO: 68129 - protein, 130 aa, Homo sapiens
  Payload ID: 13580
  Gene Symbol: PICK1
  Gene Name: protein interacting with PRKCA 1
  ENSP ID: ENSP00000410793
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIGQRLGFHGPGPHSS

SEQ ID NO: 68130 - protein, 51 aa, Homo sapiens; identical to SEQ ID NO: 68126
  Payload ID: 13580
  Gene Symbol: PICK1
  Gene Name: protein interacting with PRKCA 1
  ENSP ID: ENSP00000413962

SEQ ID NO: 68131 - protein, 38 aa, Homo sapiens
  Payload ID: 13580
  Gene Symbol: PICK1
  Gene Name: protein interacting with PRKCA 1
  ENSP ID: ENSP00000416487
MFADLDYDIEEDKLGIPTVPGKVTLQKDAQNLIGISIG

SEQ ID NO: 68132 - protein, 76 aa, Homo sapiens
  Payload ID: 13581
  Gene Symbol: PKIA
  Gene Name: protein kinase (cAMP-dependent, catalytic) inhibitor alpha
  Uniprot ID: P61925
  ENSP ID: ENSP00000336552
MTDVETTYADFIASGRTGRRNAIHDILVSSASGNSNELALKLAGLDINKTEGEEDAQRSSTEQSGEAQGEAAKSES

SEQ ID NO: 68133 - protein, 76 aa, Homo sapiens; identical to SEQ ID NO: 68132
  Payload ID: 13581
  Gene Symbol: PKIA
  Gene Name: protein kinase (cAMP-dependent, catalytic) inhibitor alpha
  Uniprot ID: P61925
  ENSP ID: ENSP00000379696

SEQ ID NO: 68134 - protein, 76 aa, Homo sapiens; identical to SEQ ID NO: 68132
  Payload ID: 13581
  Gene Symbol: PKIA
  Gene Name: protein kinase (cAMP-dependent, catalytic) inhibitor alpha
  Uniprot ID: P61925
  ENSP ID: ENSP00000430887

SEQ ID NO: 68135 - protein, 85 aa, Homo sapiens
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000258014
MSHQDVAMRTDSSKMTDVESGVANFASSARAGRRNALPDIQSSAATDGTSDLPLKLEALSVKEDAKEKDEKTTQDQLEKPQNEEK

SEQ ID NO: 68136 - protein, 78 aa, Homo sapiens
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000346227
MRTDSSKMTDVESGVANFASSARAGRRNALPDIQSSAATDGTSDLPLKLEALSVKEDAKEKDEKTTQDQLEKPQNEEK

SEQ ID NO: 68137 - protein, 87 aa, Homo sapiens
  Payload ID: 13582
  Gene Symbol: PKIB
  Gene Name: protein kinase (cAMP-dependent, catalytic) inhibitor beta
  ENSP ID: ENSP00000357431
MHILFVDVAMRTDSSKMTDVESGVANFASSARAGRRNALPDIQSSAATDGTSDLPLKLEALSVKEDAKEKDEKTTQDQLEKPQNEEK

SEQ ID NO: 68138 - protein, 78 aa, Homo sapiens; identical to SEQ ID NO: 68136
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000357433

SEQ ID NO: 68139 - protein, 78 aa, Homo sapiens; identical to SEQ ID NO: 68136
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000357437

SEQ ID NO: 68140 - protein, 78 aa, Homo sapiens; identical to SEQ ID NO: 68136
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000376280

SEQ ID NO: 68141 - protein, 78 aa, Homo sapiens; identical to SEQ ID NO: 68136
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000376281

SEQ ID NO: 68142 - protein, 85 aa, Homo sapiens; identical to SEQ ID NO: 68135
  Payload ID: 13582
  Gene Symbol: PKIB
  Gene Name: protein kinase (cAMP-dependent, catalytic) inhibitor beta
  Uniprot ID: Q9C010
  ENSP ID: ENSP00000480824

SEQ ID NO: 68143 - protein, 76 aa, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000338067
MMEVESSYSDFISCDRTGRRNAVPDIQGDSEAVSVRKLAGDMGELALEGAEGQVEGSAPDKEAGNQPQSSDGTTSS

SEQ ID NO: 68144 - protein, 76 aa, Homo sapiens; identical to SEQ ID NO: 68143
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000361977

SEQ ID NO: 68145 - protein, 64 aa, Homo sapiens
  Payload ID: 13583
  Gene Symbol: PKIG
  Gene Name: protein kinase (cAMP-dependent, catalytic) inhibitor gamma
  ENSP ID: ENSP00000361978
MMEVESSYSDFISCDRTGRRNAVPDIQGDSEAVSVRKLAGDMGELALEGAEMDLTMLPWLVSNS

SEQ ID NO: 68146 - protein, 76 aa, Homo sapiens; identical to SEQ ID NO: 68143
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000361980

SEQ ID NO: 68147 - protein, 76 aa, Homo sapiens; identical to SEQ ID NO: 68143
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000361981

SEQ ID NO: 68148 - protein, 76 aa, Homo sapiens; identical to SEQ ID NO: 68143
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000361983

SEQ ID NO: 68149 - protein, 76 aa, Homo sapiens; identical to SEQ ID NO: 68143
  Payload ID: 13583
  Gene Symbol: PKIG
  Gene Name: protein kinase (cAMP-dependent, catalytic) inhibitor gamma
  Uniprot ID: Q9Y2B9
  ENSP ID: ENSP00000361985

SEQ ID NO: 68150 - protein, 444 aa, Homo sapiens
  Payload ID: 13584
  Gene Symbol: PACSIN1
  Gene Name: protein kinase C and casein kinase substrate in neurons 1
  Uniprot ID: Q9BY11
  ENSP ID: ENSP00000244458
MSSSYDEASLAPEETTDSFWEVGNYKRTVKRIDDGHRLCNDLMNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGEEDEQGWCRGRLDSGQLGLYPANYVEAI

SEQ ID NO: 68151 - protein, 402 aa, Homo sapiens
  Payload ID: 13584
  Gene Symbol: PACSIN1
  Gene Name: protein kinase C and casein kinase substrate in neurons 1
  ENSP ID: ENSP00000363155
MNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGEEDEQGWCRGRLDSGQLGLYPANYVEAI

SEQ ID NO: 68152 - protein, 444 aa, Homo sapiens; identical to SEQ ID NO: 68150
  Payload ID: 13584
  Gene Symbol: PACSIN1
  Gene Name: protein kinase C and casein kinase substrate in neurons 1
  Uniprot ID: Q9BY11
  ENSP ID: ENSP00000439639

SEQ ID NO: 68153 - protein, 444 aa, Homo sapiens; identical to SEQ ID NO: 68150
  Payload ID: 13584
  Gene Symbol: PACSIN1
  Gene Name: protein kinase C and casein kinase substrate in neurons 1
  Uniprot ID: Q9BY11
  ENSP ID: ENSP00000484060

SEQ ID NO: 68154 - protein, 486 aa, Homo sapiens
  Payload ID: 13585
  Gene Symbol: PACSIN2
  Gene Name: protein kinase C and casein kinase substrate in neurons 2
  Uniprot ID: Q9UNF0
  ENSP ID: ENSP00000263246
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 68155 - protein, 445 aa, Homo sapiens
  Payload ID: 13585
  Gene Symbol: PACSIN2
  Gene Name: protein kinase C and casein kinase substrate in neurons 2
  Uniprot ID: Q9UNF0
  ENSP ID: ENSP00000338379
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 68156 - protein, 486 aa, Homo sapiens; identical to SEQ ID NO: 68154
  Payload ID: 13585
  Gene Symbol: PACSIN2
  Gene Name: protein kinase C and casein kinase substrate in neurons 2
  Uniprot ID: Q9UNF0
  ENSP ID: ENSP00000385040

SEQ ID NO: 68157 - protein, 486 aa, Homo sapiens; identical to SEQ ID NO: 68154
  Payload ID: 13585
  Gene Symbol: PACSIN2
  Gene Name: protein kinase C and casein kinase substrate in neurons 2
  Uniprot ID: Q9UNF0
  ENSP ID: ENSP00000385372

SEQ ID NO: 68158 - protein, 445 aa, Homo sapiens; identical to SEQ ID NO: 68155
  Payload ID: 13585
  Gene Symbol: PACSIN2
  Gene Name: protein kinase C and casein kinase substrate in neurons 2
  Uniprot ID: Q9UNF0
  ENSP ID: ENSP00000385952

SEQ ID NO: 68159 - protein, 152 aa, Homo sapiens
  Payload ID: 13585
  Gene Symbol: PACSIN2
  Gene Name: protein kinase C and casein kinase substrate in neurons 2
  ENSP ID: ENSP00000396816
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEV

SEQ ID NO: 68160 - protein, 155 aa, Homo sapiens
  Payload ID: 13585
  Gene Symbol: PACSIN2
  Gene Name: protein kinase C and casein kinase substrate in neurons 2
  ENSP ID: ENSP00000398573
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVHLS

SEQ ID NO: 68161 - protein, 33 aa, Homo sapiens
  Payload ID: 13585
  Gene Symbol: PACSIN2
  Gene Name: protein kinase C and casein kinase substrate in neurons 2
  ENSP ID: ENSP00000399953
MSVTYDDSVGVEVSSDSFWEVGNYKRTVKRIDD

SEQ ID NO: 68162 - protein, 152 aa, Homo sapiens; identical to SEQ ID NO: 68159
  Payload ID: 13585
  Gene Symbol: PACSIN2
  Gene Name: protein kinase C and casein kinase substrate in neurons 2
  ENSP ID: ENSP00000403435

SEQ ID NO: 68163 - protein, 59 aa, Homo sapiens
  Payload ID: 13585
  Gene Symbol: PACSIN2
  Gene Name: protein kinase C and casein kinase substrate in neurons 2
  ENSP ID: ENSP00000422788
  MOD_RES (1)..(1): Any amino acid
XTEVRVRALYDYEGQEHDELSFKAETGFHHIIQSGLELLSSSDPPASASQSAGITGMSP

SEQ ID NO: 68164 - protein, 451 aa, Homo sapiens
  Payload ID: 13585
  Gene Symbol: PACSIN2
  Gene Name: protein kinase C and casein kinase substrate in neurons 2
  ENSP ID: ENSP00000489297
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEDEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKA

SEQ ID NO: 68165 - protein, 424 aa, Homo sapiens [sequence omitted]

SEQ ID NO: 68166 - protein, 69 aa, Homo sapiens
  Payload ID: 13586
  Gene Symbol: PACSIN3
  Gene Name: protein kinase C and casein kinase substrate in neurons 3
  ENSP ID: ENSP00000431861
MAPEEDAGGEALGGSFWEAGNYRRTVQRVEDGHRLCGDLVSCFQERARIEKAYAQQLADWARKWRGTVE

SEQ ID NO: 68167 - protein, 48 aa, Homo sapiens
  Payload ID: 13586
  Gene Symbol: PACSIN3
  Gene Name: protein kinase C and casein kinase substrate in neurons 3
  ENSP ID: ENSP00000431924
MEDMEQAFETCQAAERQRLLFFKDMLLTLHQHLDLSSSEKFHELHRDL

SEQ ID NO: 68168 - protein, 320 aa, Homo sapiens
  Payload ID: 13586
  Gene Symbol: PACSIN3
  Gene Name: protein kinase C and casein kinase substrate in neurons 3
  ENSP ID: ENSP00000431948
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRESHAKADSAVSQEQLRKLQERVERCAKEAEKTKAQYEQTLAELHRYTPRYMEDMEQAFETCQAAERQRLLFFKDMLLTLHQHLDLSSSEKFHELHRDLHQGIEAASDEEDLRWWRSTHGPGMAMNWPQFEALVLGHTEDNQPEREGWPEP

SEQ ID NO: 68169 - protein, 76 aa, Homo sapiens
  Payload ID: 13586
  Gene Symbol: PACSIN3
  Gene Name: protein kinase C and casein kinase substrate in neurons 3
  ENSP ID: ENSP00000433962
  MOD_RES (1)..(1): Any amino acid
XEDLRWWRSTHGPGMAMNWPQFEEWSLDTQRTISRKEKGGRSPDEVTLTSIVPTRDGTAPPPQSPGSPGGGAAEDE

SEQ ID NO: 68170 - protein, 36 aa, Homo sapiens
  Payload ID: 13586
  Gene Symbol: PACSIN3
  Gene Name: protein kinase C and casein kinase substrate in neurons 3
  ENSP ID: ENSP00000434521
MEDMEQAFETCQAAERQRLLFFKDMLLTLHQHLDLS

SEQ ID NO: 68171 - protein, 148 aa, Homo sapiens
  Payload ID: 13586
  Gene Symbol: PACSIN3
  Gene Name: protein kinase C and casein kinase substrate in neurons 3
  ENSP ID: ENSP00000434699
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLK

SEQ ID NO: 68172 - protein, 142 aa, Homo sapiens
  Payload ID: 13586
  Gene Symbol: PACSIN3
  Gene Name: protein kinase C and casein kinase substrate in neurons 3
  ENSP ID: ENSP00000435638
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKP

SEQ ID NO: 68173 - protein, 69 aa, Homo sapiens; identical to SEQ ID NO: 68166
  Payload ID: 13586
  Gene Symbol: PACSIN3
  Gene Name: protein kinase C and casein kinase substrate in neurons 3
  ENSP ID: ENSP00000435672

SEQ ID NO: 68174 - protein, 405 aa, Homo sapiens
  Payload ID: 13586
  Gene Symbol: PACSIN3
  Gene Name: protein kinase C and casein kinase substrate in neurons 3
  ENSP ID: ENSP00000437252
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRESHAKADSAVSQEQLRKLQERVERCAKEAEKTKAQYEQTLAELHRYTPRYMEDMEQAFETCQAAERQRLLFFKDMLLTLHQHLDLSSSEKFHELHRDLHQGIEAASDEEDLRWWRSTHGPGMAMNWPQFEEWSLDTQRTISRKEKGGRSPDEVTLTSIVPTRDGTAPPPQSPGSPGTGQDEEWSDEESPRKAATGVRVRALYDYAGQEADELSFRAGEELLKMSEEDEQGWCQGQ

SEQ ID NO: 68175 - protein, 424 aa, Homo sapiens [sequence omitted]

SEQ ID NO: 68176 - protein, 62 aa, Homo sapiens
  Payload ID: 13587
  Gene Symbol: PRKCSH
  Gene Name: protein kinase C substrate 80K-H
  ENSP ID: ENSP00000464835
MLLPLLLLLPMCWAVEVKRPRGVSLTNHHFYDESKPFTCLDGSATIPFDQVNDDYCDCKDGS

SEQ ID NO: 68177 - protein, 144 aa, Homo sapiens
  Payload ID: 13587
  Gene Symbol: PRKCSH
  Gene Name: protein kinase C substrate 80K-H
  ENSP ID: ENSP00000465047
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKIL

SEQ ID NO: 68178 - protein, 528 aa, Homo sapiens
  Payload ID: 13587
  Gene Symbol: PRKCSH
  Gene Name: protein kinase C substrate 80K-H
  Uniprot ID: P14314
  ENSP ID: ENSP00000465461
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 68179 - protein, 525 aa, Homo sapiens
  Payload ID: 13587
  Gene Symbol: PRKCSH
  Gene Name: protein kinase C substrate 80K-H
  Uniprot ID: P14314
  ENSP ID: ENSP00000465489
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 68180 - protein, 140 aa, Homo sapiens
  Payload ID: 13587
  Gene Symbol: PRKCSH
  Gene Name: protein kinase C substrate 80K-H
  ENSP ID: ENSP00000465821
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRL

SEQ ID NO: 68181 - protein, 132 aa, Homo sapiens
  Payload ID: 13587
  Gene Symbol: PRKCSH
  Gene Name: protein kinase C substrate 80K-H
  ENSP ID: ENSP00000465889
MLLPLLLLLPMCWAVEVKRPRGVSLTSESSCSPSRQAGGGRGQHWALGIGIYSLLTQFPGSAPLVGMGGQRWYLVEKALTCPGLSFLYPADHHFYDESKPFTCLDGSATIPFDQVNDDYCDCKDGSDEPGTA

SEQ ID NO: 68182 - protein, 200 aa, Homo sapiens
  Payload ID: 13587
  Gene Symbol: PRKCSH
  Gene Name: protein kinase C substrate 80K-H
  ENSP ID: ENSP00000465948
AEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 68183 - protein, 525 aa, Homo sapiens; identical to SEQ ID NO: 68179
  Payload ID: 13587
  Gene Symbol: PRKCSH
  Gene Name: protein kinase C substrate 80K-H
  Uniprot ID: P14314
  ENSP ID: ENSP00000466012

SEQ ID NO: 68184 - protein, 535 aa, Homo sapiens
  Payload ID: 13587
  Gene Symbol: PRKCSH
  Gene Name: protein kinase C substrate 80K-H
  ENSP ID: ENSP00000466134
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 68185 - protein, 168 aa, Homo sapiens
  Payload ID: 13587
  Gene Symbol: PRKCSH
  Gene Name: protein kinase C substrate 80K-H
  ENSP ID: ENSP00000467566
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKS

SEQ ID NO: 68186 - protein, 150 aa, Homo sapiens
  Payload ID: 13588
  Gene Symbol: PRKCA
  Gene Name: protein kinase C, alpha
  ENSP ID: ENSP00000284384
  MOD_RES (1)..(1): Any amino acid
XVFPGNDSTASQDVANRFARKGALRQKNVHEVKDHKFIARFFKQPTFCSHCTDFIWGFGKQGFQCQVCCFVVHKRCHEFVTFSCPGADKGPDTDLFSPVLLVCLYLLRSYSLSEGPQEQAQVQNPHLRKPHLLRSLWVTALWTYPSRDEM

SEQ ID NO: 68187 - protein, 672 aa, Homo sapiens
  Payload ID: 13588
  Gene Symbol: PRKCA
  Gene Name: protein kinase C, alpha
  Uniprot ID: P17252
  ENSP ID: ENSP00000408695
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSVCKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 68188 - protein, 308 aa, Homo sapiens
  Payload ID: 13588
  Gene Symbol: PRKCA
  Gene Name: protein kinase C, alpha
  ENSP ID: ENSP00000462087
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEWR

SEQ ID NO: 68189 - protein, 673 aa, Homo sapiens
  Payload ID: 13589
  Gene Symbol: PRKCB
  Gene Name: protein kinase C, beta
  Uniprot ID: P05771
  ENSP ID: ENSP00000305355
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 68190 - protein, 671 aa, Homo sapiens
  Payload ID: 13589
  Gene Symbol: PRKCB
  Gene Name: protein kinase C, beta
  Uniprot ID: P05771
  ENSP ID: ENSP00000318315
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 68191 - protein, 57 aa, Homo sapiens
  Payload ID: 13589
  Gene Symbol: PRKCB
  Gene Name: protein kinase C, beta
  ENSP ID: ENSP00000454428
MADPAAGPPPSEGEESTVRFARKGALRQKNVHEVKNHKFTARFFKQPTFCSHCTDFI

SEQ ID NO: 68192 - protein, 130 aa, Homo sapiens
  Payload ID: 13589
  Gene Symbol: PRKCB
  Gene Name: protein kinase C, beta
  ENSP ID: ENSP00000457980
MGVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIA

SEQ ID NO: 68193 - protein, 122 aa, Homo sapiens
  Payload ID: 13589
  Gene Symbol: PRKCB
  Gene Name: protein kinase C, beta
  ENSP ID: ENSP00000458564
  MOD_RES (1)..(1): Any amino acid
XSMSKEAVAICKGLMTKHPGKRLGCGPEGERDIKEHAFFRYIDWEKLERKEIQPPYKPKAVSSPFSLTAGYSHTRYSCLCLMFSKCSLRGRRQCVYWNMGVCIHTYAQNHWLLRWTFSIGPA

SEQ ID NO: 68194 - protein, 119 aa, Homo sapiens
  Payload ID: 13589
  Gene Symbol: PRKCB
  Gene Name: protein kinase C, beta
  ENSP ID: ENSP00000459227
MDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQK

SEQ ID NO: 68195 - protein, 676 aa, Homo sapiens
  Payload ID: 13590
  Gene Symbol: PRKCD
  Gene Name: protein kinase C, delta
  Uniprot ID: Q05655
  ENSP ID: ENSP00000331602
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 68196 - protein, 676 aa, Homo sapiens; identical to SEQ ID NO: 68195
  Payload ID: 13590
  Gene Symbol: PRKCD
  Gene Name: protein kinase C, delta
  Uniprot ID: Q05655
  ENSP ID: ENSP00000378217

SEQ ID NO: 68197 - protein, 125 aa, Homo sapiens
  Payload ID: 13590
  Gene Symbol: PRKCD
  Gene Name: protein kinase C, delta
  ENSP ID: ENSP00000418106
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDV

SEQ ID NO: 68198 - protein, 223 aa, Homo sapiens
  Payload ID: 13590
  Gene Symbol: PRKCD
  Gene Name: protein kinase C, delta
  ENSP ID: ENSP00000419629
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRHCGMNVHHKCREKVANLCGINQKLLAEALNQVT

SEQ ID NO: 68199 - protein, 77 aa, Homo sapiens
  Payload ID: 13590
  Gene Symbol: PRKCD
  Gene Name: protein kinase C, delta
  ENSP ID: ENSP00000419726
MAPFLRIAFNSYELGSLQAEDEANQPFCAVKMKEALSTERGKTLVQKKPTMYPEWKSTFDAHIYEGRVIQIVLMRAA

SEQ ID NO: 68200 - protein, 261 aa, Homo sapiens
  Payload ID: 13591
  Gene Symbol: PRKCDBP
  Gene Name: protein kinase C, delta binding protein
  Uniprot ID: Q969G5
  ENSP ID: ENSP00000307292
MRESALERGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKEEGEVPASAFQKAPEPLGPADQSELGPEQLEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 68201 - protein, 293 aa, Homo sapiens
  Payload ID: 13591
  Gene Symbol: PRKCDBP
  Gene Name: protein kinase C, delta binding protein
  ENSP ID: ENSP00000432047
MRESALERGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKASPTLQRFAVRTQLSLPLPSHACLSPQTLAAEEEGEVPASAFQKAPEPLGPADQSELGPEQLEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 68202 - protein, 737 aa, Homo sapiens
  Payload ID: 13592
  Gene Symbol: PRKCE
  Gene Name: protein kinase C, epsilon
  Uniprot ID: Q02156
  ENSP ID: ENSP00000306124
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 68203 - protein, 219 aa, Homo sapiens
  Payload ID: 13592
  Gene Symbol: PRKCE
  Gene Name: protein kinase C, epsilon
  ENSP ID: ENSP00000378341
MNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKGTGFSIQGCACEGMREL

SEQ ID NO: 68204 - protein, 127 aa, Homo sapiens
  Payload ID: 13592
  Gene Symbol: PRKCE
  Gene Name: protein kinase C, epsilon
  ENSP ID: ENSP00000394574
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYV

SEQ ID NO: 68205 - protein, 683 aa, Homo sapiens
  Payload ID: 13593
  Gene Symbol: PRKCH
  Gene Name: protein kinase C, eta
  Uniprot ID: P24723
  ENSP ID: ENSP00000329127
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 68206 - protein, 83 aa, Homo sapiens
  Payload ID: 13593
  Gene Symbol: PRKCH
  Gene Name: protein kinase C, eta
  ENSP ID: ENSP00000450959
MRRRVHQINGHKFMATYLRQPTYCSHCREFIWGVFGKQGYQCQVCTCVVHKRCHHLIVTACTCQNNINKVDSKIAEQRFGINI

SEQ ID NO: 68207 - protein, 522 aa, Homo sapiens
  Payload ID: 13593
  Gene Symbol: PRKCH
  Gene Name: protein kinase C, eta
  Uniprot ID: P24723
  ENSP ID: ENSP00000450981
MRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 68208 - protein, 73 aa, Homo sapiens
  Payload ID: 13593
  Gene Symbol: PRKCH
  Gene Name: protein kinase C, eta
  ENSP ID: ENSP00000451205
MRRRVHQINGHKFMATYLRQPTYCSHCREFIWGVFGKQGYQCQVCTCVVHKRCHHLIVTACTCQNNINKVDSK

SEQ ID NO: 68209 - protein, 15 aa, Homo sapiens
  Payload ID: 13593
  Gene Symbol: PRKCH
  Gene Name: protein kinase C, eta
  ENSP ID: ENSP00000451789
MRRRVHQINGHKFMA

SEQ ID NO: 68210 - protein, 53 aa, Homo sapiens
  Payload ID: 13593
  Gene Symbol: PRKCH
  Gene Name: protein kinase C, eta
  ENSP ID: ENSP00000451793
MRQGLQCKICKMNVHIRCQANVAPNCGVNAVELAKTLAGMGLQPGNISPTSKL

SEQ ID NO: 68211 - protein, 151 aa, Homo sapiens
  Payload ID: 13593
  Gene Symbol: PRKCH
  Gene Name: protein kinase C, eta
  ENSP ID: ENSP00000451871
MEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATG

SEQ ID NO: 68212 - protein, 224 aa, Homo sapiens
  Payload ID: 13593
  Gene Symbol: PRKCH
  Gene Name: protein kinase C, eta
  ENSP ID: ENSP00000451930
MRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKV

SEQ ID NO: 68213 - protein, 87 aa, Homo sapiens
  Payload ID: 13593
  Gene Symbol: PRKCH
  Gene Name: protein kinase C, eta
  ENSP ID: ENSP00000451933
MRRRVHQINGHKFMATYLRQPTYCSHCREFIWGVFGKQGYQCQVCTCVVHKRCHHLIVTACTCQNNINKVDSKIAEQRFGINIPHKF

SEQ ID NO: 68214 - protein, 129 aa, Homo sapiens
  Payload ID: 13593
  Gene Symbol: PRKCH
  Gene Name: protein kinase C, eta
  ENSP ID: ENSP00000452055
MRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQAN

SEQ ID NO: 68215 - protein, 118 aa, Homo sapiens
  Payload ID: 13593
  Gene Symbol: PRKCH
  Gene Name: protein kinase C, eta
  ENSP ID: ENSP00000452129
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTF

SEQ ID NO: 68216 - protein, 71 aa, Homo sapiens
  Payload ID: 13593
  Gene Symbol: PRKCH
  Gene Name: protein kinase C, eta
  ENSP ID: ENSP00000452330
MRRRVHQINGHKFMATYLRQPTYCSHCREFIWGVFGKQGYQCQVCTCVVHKRCHHLIVTACTCQNNINKVD

SEQ ID NO: 68217 - protein, 106 aa, Homo sapiens
  Payload ID: 13593
  Gene Symbol: PRKCH
  Gene Name: protein kinase C, eta
  ENSP ID: ENSP00000452528
MRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLW

SEQ ID NO: 68218 - protein, 144 aa, Homo sapiens
  Payload ID: 13593
  Gene Symbol: PRKCH
  Gene Name: protein kinase C, eta
  ENSP ID: ENSP00000452588
MQSAGDMGRQEELEAASWKDLGAPSGRKDWLGRIPGCFPGSALPKTLCSLQPWRASFSQFLSEVDLEPEGKVFVVITLTGSFTEATLQRDRIFKHFTRKRQRAMRRRVHQINGHKFMATYLRQPTYCSHCREFIWGVFGKQGYQ

SEQ ID NO: 68219 - protein, 697 aa, Homo sapiens
  Payload ID: 13594
  Gene Symbol: PRKCG
  Gene Name: protein kinase C, gamma
  Uniprot ID: P05129
  ENSP ID: ENSP00000263431
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 68220 - protein, 35 aa, Homo sapiens
  Payload ID: 13594
  Gene Symbol: PRKCG
  Gene Name: protein kinase C, gamma
  ENSP ID: ENSP00000387919
MKCSCCEMNVHRRCVRSVPSLCGVDHTERRGRLQL

SEQ ID NO: 68221 - protein, 99 aa, Homo sapiens
  Payload ID: 13594
  Gene Symbol: PRKCG
  Gene Name: protein kinase C, gamma
  ENSP ID: ENSP00000471271
MKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETF

SEQ ID NO: 68222 - protein, 19 aa, Homo sapiens
  Payload ID: 13594
  Gene Symbol: PRKCG
  Gene Name: protein kinase C, gamma
  ENSP ID: ENSP00000471544
MKCSCCEMNVHRRCVRSVP

SEQ ID NO: 68223 - protein, 596 aa, Homo sapiens
  Payload ID: 13595
  Gene Symbol: PRKCI
  Gene Name: protein kinase C, iota
  Uniprot ID: P41743
  ENSP ID: ENSP00000295797
MPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 68224 - protein, 706 aa, Homo sapiens
  Payload ID: 13596
  Gene Symbol: PRKCQ
  Gene Name: protein kinase C, theta
  Uniprot ID: Q04759
  ENSP ID: ENSP00000263125
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 68225 - protein, 643 aa, Homo sapiens
  Payload ID: 13596
  Gene Symbol: PRKCQ
  Gene Name: protein kinase C, theta
  Uniprot ID: Q04759
  ENSP ID: ENSP00000380361
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPELFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 68226 - protein, 581 aa, Homo sapiens
  Payload ID: 13596
  Gene Symbol: PRKCQ
  Gene Name: protein kinase C, theta
  Uniprot ID: Q04759
  ENSP ID: ENSP00000441752
MDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 68227 - protein, 670 aa, Homo sapiens [sequence omitted]

SEQ ID NO: 68228 - protein, 592 aa, Homo sapiens
  Payload ID: 13597
  Gene Symbol: PRKCZ
  Gene Name: protein kinase C, zeta
  Uniprot ID: Q05513
  ENSP ID: ENSP00000367830
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 68229 - protein, 409 aa, Homo sapiens
  Payload ID: 13597
  Gene Symbol: PRKCZ
  Gene Name: protein kinase C, zeta
  Uniprot ID: Q05513
  ENSP ID: ENSP00000383711
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 68230 - protein, 409 aa, Homo sapiens; identical to SEQ ID NO: 68229
  Payload ID: 13597
  Gene Symbol: PRKCZ
  Gene Name: protein kinase C, zeta
  Uniprot ID: Q05513
  ENSP ID: ENSP00000383712

SEQ ID NO: 68231 - protein, 109 aa, Homo sapiens
  Payload ID: 13597
  Gene Symbol: PRKCZ
  Gene Name: protein kinase C, zeta
  ENSP ID: ENSP00000421219
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDE

SEQ ID NO: 68232 - protein, 82 aa, Homo sapiens
  Payload ID: 13597
  Gene Symbol: PRKCZ
  Gene Name: protein kinase C, zeta
  ENSP ID: ENSP00000421350
MDSVMPSQEPPVDDKNEDADLPSEETDGIAYISSSRKHDSIKDDSEDLKPVIDGMDGIKISQGLGLQDFDLIRVIGRGSYAK

SEQ ID NO: 68233 - protein, 65 aa, Homo sapiens
  Payload ID: 13597
  Gene Symbol: PRKCZ
  Gene Name: protein kinase C, zeta
  ENSP ID: ENSP00000421587
MCRLHQQHPLTLKWVDSEGDPCTVSSQMELEEAFRLARQCRDEGLIIHVFPSTPEQPGLPCPGED

SEQ ID NO: 68234 - protein, 70 aa, Homo sapiens
  Payload ID: 13597
  Gene Symbol: PRKCZ
  Gene Name: protein kinase C, zeta
  ENSP ID: ENSP00000421869
MDSVMPSQEPPVDDKNEDADLPSEETDGIAYISSSRKHDSIKDDSEDLKPVIDGMDGIKISQGLGLQDFD

SEQ ID NO: 68235 - protein, 46 aa, Homo sapiens
  Payload ID: 13597
  Gene Symbol: PRKCZ
  Gene Name: protein kinase C, zeta
  ENSP ID: ENSP00000422349
MDSVMPSQEPPVDDKNEDADLPSEETDGIAYISSSRKHDSIKDDSE

SEQ ID NO: 68236 - protein, 105 aa, Homo sapiens
  Payload ID: 13597
  Gene Symbol: PRKCZ
  Gene Name: protein kinase C, zeta
  ENSP ID: ENSP00000422764
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDE

SEQ ID NO: 68237 - protein, 98 aa, Homo sapiens
  Payload ID: 13597
  Gene Symbol: PRKCZ
  Gene Name: protein kinase C, zeta
  ENSP ID: ENSP00000424228
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMK

SEQ ID NO: 68238 - protein, 347 aa, Homo sapiens
  Payload ID: 13597
  Gene Symbol: PRKCZ
  Gene Name: protein kinase C, zeta
  ENSP ID: ENSP00000424398
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLVFHTKNTSN

SEQ ID NO: 68239 - protein, 136 aa, Homo sapiens
  Payload ID: 13597
  Gene Symbol: PRKCZ
  Gene Name: protein kinase C, zeta
  ENSP ID: ENSP00000424763
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTT

SEQ ID NO: 68240 - protein, 181 aa, Homo sapiens
  Payload ID: 13597
  Gene Symbol: PRKCZ
  Gene Name: protein kinase C, zeta
  ENSP ID: ENSP00000424945
MPSRTGPKMEGSGGRVRLKAHYGGDIFITSVDAATTFEELCEEVRDMCRLHQQHPLTLKWVDSEVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDG

SEQ ID NO: 68241 - protein, 73 aa, Homo sapiens
  Payload ID: 13597
  Gene Symbol: PRKCZ
  Gene Name: protein kinase C, zeta
  ENSP ID: ENSP00000425317
MDSVMPSQEPPVDDKNEDADLPSEETDGIAYISSSRKHDSIKDDSEDLKPVIDGMDGIKISQGLGLQDFDLIR

SEQ ID NO: 68242 - protein, 73 aa, Homo sapiens
  Payload ID: 13597
  Gene Symbol: PRKCZ
  Gene Name: protein kinase C, zeta
  ENSP ID: ENSP00000425643
MDLANHLFQVAGYPAAVDRVKSGSLCLFIYLGQQRELSLHGDCNFILIYLPPGSQKMEEAVPCQRPPLPSQAL

SEQ ID NO: 68243 - protein, 488 aa, Homo sapiens
  Payload ID: 13597
  Gene Symbol: PRKCZ
  Gene Name: protein kinase C, zeta
  Uniprot ID: Q05513
  ENSP ID: ENSP00000426412
MLTPRTDESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 68244 - protein, 21 aa, Homo sapiens
  Payload ID: 13597
  Gene Symbol: PRKCZ
  Gene Name: protein kinase C, zeta
  ENSP ID: ENSP00000427085
MDSVMPSQEPPVDDKNEDADL

SEQ ID NO: 68245 - protein, 25 aa, Homo sapiens
  Payload ID: 13597
  Gene Symbol: PRKCZ
  Gene Name: protein kinase C, zeta
  ENSP ID: ENSP00000427134
MDSVMPSQEPPVDDKNEDADLPSEE

SEQ ID NO: 68246 - protein, 61 aa, Homo sapiens
  Payload ID: 13597
  Gene Symbol: PRKCZ
  Gene Name: protein kinase C, zeta
  ENSP ID: ENSP00000462105
MDSVMPSQEPPVDDKNEDADLPSEETDGIAYISSSRKHDSIKDDSEDLKPVIDGMDGIKIS

SEQ ID NO: 68247 - protein, 912 aa, Homo sapiens
  Payload ID: 13598
  Gene Symbol: PRKD1
  Gene Name: protein kinase D1
  Uniprot ID: Q15139
  ENSP ID: ENSP00000333568
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 68248 - protein, 920 aa, Homo sapiens
  Payload ID: 13598
  Gene Symbol: PRKD1
  Gene Name: protein kinase D1
  ENSP ID: ENSP00000390535
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLSPVSPGFEQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 68249 - protein, 117 aa, Homo sapiens
  Payload ID: 13598
  Gene Symbol: PRKD1
  Gene Name: protein kinase D1
  ENSP ID: ENSP00000446866
MILSPPQPCGTFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPN

SEQ ID NO: 68250 - protein, 157 aa, Homo sapiens
  Payload ID: 13598
  Gene Symbol: PRKD1
  Gene Name: protein kinase D1
  ENSP ID: ENSP00000447333
SSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHSESASFLTSPKLIMCLPLA

SEQ ID NO: 68251 - protein, 80 aa, Homo sapiens
  Payload ID: 13598
  Gene Symbol: PRKD1
  Gene Name: protein kinase D1
  ENSP ID: ENSP00000447723
EVLRNKGYNRSLDMWSVGVIIYVSLSGTFPFNEDEDIHDQIQNAAFMYPPNPWKEISHEDVDLIQYNTYILGCLSSHCTA

SEQ ID NO: 68252 - protein, 912 aa, Homo sapiens; identical to SEQ ID NO: 68247
  Payload ID: 13598
  Gene Symbol: PRKD1
  Gene Name: protein kinase D1
  Uniprot ID: Q15139
  ENSP ID: ENSP00000482645

SEQ ID NO: 68253 - protein, 878 aa, Homo sapiens
  Payload ID: 13599
  Gene Symbol: PRKD2
  Gene Name: protein kinase D2
  Uniprot ID: Q9BZL6
  ENSP ID: ENSP00000291281
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 68254 - protein, 878 aa, Homo sapiens; identical to SEQ ID NO: 68253
  Payload ID: 13599
  Gene Symbol: PRKD2
  Gene Name: protein kinase D2
  Uniprot ID: Q9BZL6
  ENSP ID: ENSP00000393978

SEQ ID NO: 68255 - protein, 73 aa, Homo sapiens
  Payload ID: 13599
  Gene Symbol: PRKD2
  Gene Name: protein kinase D2
  ENSP ID: ENSP00000469064
SGVSFHIQIGLTREFVLLPAASELAHVKQLACSIVDQKPRPPSRTSRSARTPSRCTPIGRLPSVITAGRCSSA

SEQ ID NO: 68256 - protein, 721 aa, Homo sapiens
  Payload ID: 13599
  Gene Symbol: PRKD2
  Gene Name: protein kinase D2
  Uniprot ID: Q9BZL6
  ENSP ID: ENSP00000469106
MLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 68257 - protein, 67 aa, Homo sapiens
  Payload ID: 13599
  Gene Symbol: PRKD2
  Gene Name: protein kinase D2
  ENSP ID: ENSP00000470363
MLFGLVRQGLKCDGCGLNYHKRCAFSIPNNCSGARKRRLSSTSLASGHSVRLGTSESLPCTAEELVR

SEQ ID NO: 68258 - protein, 94 aa, Homo sapiens
  Payload ID: 13599
  Gene Symbol: PRKD2
  Gene Name: protein kinase D2
  ENSP ID: ENSP00000470442
MLFGLVRQGLKCDDCKFNCHKRCATRVPNDCLGEALINGDVPMEEATDFSEADKSALMDESEDSGVIPGSHSENALHASEEEEGEGGKAQSSLG

SEQ ID NO: 68259 - protein, 888 aa, Homo sapiens
  Payload ID: 13599
  Gene Symbol: PRKD2
  Gene Name: protein kinase D2
  ENSP ID: ENSP00000470804
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGGAWGPPTPWAAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 68260 - protein, 18 aa, Homo sapiens
  Payload ID: 13599
  Gene Symbol: PRKD2
  Gene Name: protein kinase D2
  ENSP ID: ENSP00000470919
MLFGLVRQGLKCDGCGLN

SEQ ID NO: 68261 - protein, 721 aa, Homo sapiens; identical to SEQ ID NO: 68256
  Payload ID: 13599
  Gene Symbol: PRKD2
  Gene Name: protein kinase D2
  Uniprot ID: Q9BZL6
  ENSP ID: ENSP00000472744

SEQ ID NO: 68262 - protein, 153 aa, Homo sapiens
  Payload ID: 13599
  Gene Symbol: PRKD2
  Gene Name: protein kinase D2
  ENSP ID: ENSP00000472913
  MOD_RES (1)..(1): Any amino acid
XQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQISAFWALACPTPKPCAKPFTS

SEQ ID NO: 68263 - protein, 68 aa, Homo sapiens
  Payload ID: 13599
  Gene Symbol: PRKD2
  Gene Name: protein kinase D2
  ENSP ID: ENSP00000472987
MATAPSYPAGLPGSPGPGSPPPPGGLELQSPPPLLPQIPAPGSGVSFHIQIGLTREFVLLPAASELAH

SEQ ID NO: 68264 - protein, 890 aa, Homo sapiens
  Payload ID: 13600
  Gene Symbol: PRKD3
  Gene Name: protein kinase D3
  Uniprot ID: O94806
  ENSP ID: ENSP00000234179
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 68265 - protein, 890 aa, Homo sapiens; identical to SEQ ID NO: 68264
  Payload ID: 13600
  Gene Symbol: PRKD3
  Gene Name: protein kinase D3
  Uniprot ID: O94806
  ENSP ID: ENSP00000368356

SEQ ID NO: 68266 - protein, 172 aa, Homo sapiens
  Payload ID: 13600
  Gene Symbol: PRKD3
  Gene Name: protein kinase D3
  ENSP ID: ENSP00000398743
TDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGDLSVLRVVTSLEDFLSSEEQRTVRGKHRKTGRDVAIKVIDKMRFPTKQESQLRNEVAILQNLHHPGIVN

SEQ ID NO: 68267 - protein, 185 aa, Homo sapiens
  Payload ID: 13600
  Gene Symbol: PRKD3
  Gene Name: protein kinase D3
  ENSP ID: ENSP00000399540
  MOD_RES (1)..(1): Any amino acid
XTSISVSNCQIQENVDISTVYQIFADEVLGSGQFGIVYGGKHRKTGRDVAIKVIDKMRFPTKQESQLRNEVAILQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFM

SEQ ID NO: 68268 - protein, 181 aa, Homo sapiens
  Payload ID: 13600
  Gene Symbol: PRKD3
  Gene Name: protein kinase D3
  ENSP ID: ENSP00000401839
MYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTIC

SEQ ID NO: 68269 - protein, 493 aa, Homo sapiens
  Payload ID: 13601
  Gene Symbol: PKDCC
  Gene Name: protein kinase domain containing, cytoplasmic
  Uniprot ID: Q504Y2
  ENSP ID: ENSP00000294964
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 68270 - protein, 181 aa, Homo sapiens
  Payload ID: 13601
  Gene Symbol: PKDCC
  Gene Name: protein kinase domain containing, cytoplasmic
  ENSP ID: ENSP00000385220
MRRRRAAVAAGFCASFLLGSVLNVLFAPGSEPPRPGQSPEPSPAPGPGRRGGRGELARQIRARYEEAGPRLPAQAPPARARAWAAPRFATCPARSTWAQATPRPCTGSACPAVPRWRSRRWTLAATIWAAACASSGYGGAAIGWRPTSCLRRWCCWSGCGTPTCCSSMATATRTARTSQTP

SEQ ID NO: 68271 - protein, 942 aa, Homo sapiens
  Payload ID: 13602
  Gene Symbol: PKN1
  Gene Name: protein kinase N1
  Uniprot ID: Q16512
  ENSP ID: ENSP00000242783
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 68272 - protein, 948 aa, Homo sapiens
  Payload ID: 13602
  Gene Symbol: PKN1
  Gene Name: protein kinase N1
  Uniprot ID: Q16512
  ENSP ID: ENSP00000343325
MAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 68273 - protein, 255 aa, Homo sapiens
  Payload ID: 13602
  Gene Symbol: PKN1
  Gene Name: protein kinase N1
  ENSP ID: ENSP00000465842
MACRPCRGAGRIWCCRSHKSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGEVSTVLKLDNTVVGQTSWKPCGPNAWDQSFTLELERARE

SEQ ID NO: 68274 - protein, 198 aa, Homo sapiens
  Payload ID: 13602
  Gene Symbol: PKN1
  Gene Name: protein kinase N1
  ENSP ID: ENSP00000465867
PGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFATPASCRPKPSAS

SEQ ID NO: 68275 - protein, 263 aa, Homo sapiens
  Payload ID: 13602
  Gene Symbol: PKN1
  Gene Name: protein kinase N1
  ENSP ID: ENSP00000466367
MACRPCRGAGRIWCCRSHKSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVS

SEQ ID NO: 68276 - protein, 151 aa, Homo sapiens
  Payload ID: 13602
  Gene Symbol: PKN1
  Gene Name: protein kinase N1
  ENSP ID: ENSP00000466819
WVRLLRRLIPNATGTGTFSPGASPGSEARTTGDISVEKLNLGTDSDSSPQKSSRDPPSSPSSLSSPIQESTAPELPSETQETPGPALCSPVGPAPATALCAHAVRPHRRQQLRRGVHRGGPHTEPAPRRAAPHSRGAGSLPGLRLRGRGLL

SEQ ID NO: 68277 - protein, 14 aa, Homo sapiens
  Payload ID: 13602
  Gene Symbol: PKN1
  Gene Name: protein kinase N1
  ENSP ID: ENSP00000467422
MIQTYSNGSTKDRK

SEQ ID NO: 68278 - protein, 226 aa, Homo sapiens
  Payload ID: 13602
  Gene Symbol: PKN1
  Gene Name: protein kinase N1
  ENSP ID: ENSP00000468497
  MOD_RES (1)..(1): Any amino acid
XNPERRLGSSERDAEDVKKQPFFRPGSRSVAQAGVQWLNLGSLQPPPPRFMQFSCLSLPSTWDYRRAPLHHTRLIFVFLVETGFRHVGQAGPELLASSDPPASASRSAGITGLSHHAGPPLFLIRLLHQALADSGLGSPVGPAPATALCAHAVRPHRRQQLRRGVHRGGPHTEPAPRRAAPHSRGAGSLPGLRLRGRGLLAPSPAPAPAPARELLVFKKAFGICRI

SEQ ID NO: 68279 - protein, 604 aa, Homo sapiens
  Payload ID: 13603
  Gene Symbol: PKN2
  Gene Name: protein kinase N2
  ENSP ID: ENSP00000317851
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPARYVSEILSISYTKLLGHSYVLIIAGVLSLAFFPSSILKVVFCLLKK

SEQ ID NO: 68280 - protein, 320 aa, Homo sapiens
  Payload ID: 13603
  Gene Symbol: PKN2
  Gene Name: protein kinase N2
  ENSP ID: ENSP00000359536
MIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCKISEVRRFFRQPTAWHVSLFGTTGYFICRGYLF

SEQ ID NO: 68281 - protein, 936 aa, Homo sapiens
  Payload ID: 13603
  Gene Symbol: PKN2
  Gene Name: protein kinase N2
  Uniprot ID: Q16513
  ENSP ID: ENSP00000359544
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 68282 - protein, 984 aa, Homo sapiens
  Payload ID: 13603
  Gene Symbol: PKN2
  Gene Name: protein kinase N2
  Uniprot ID: Q16513
  ENSP ID: ENSP00000359552
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 68283 - protein, 65 aa, Homo sapiens
  Payload ID: 13603
  Gene Symbol: PKN2
  Gene Name: protein kinase N2
  ENSP ID: ENSP00000389076
  MOD_RES (1)..(1): Any amino acid
XGFVKIADFGLCKEGMGYGDRTSTFCGTPEFLAPEVLTETSYTRAVDWWGLGVLIYEMLVGETSV

SEQ ID NO: 68284 - protein, 211 aa, Homo sapiens
  Payload ID: 13603
  Gene Symbol: PKN2
  Gene Name: protein kinase N2
  ENSP ID: ENSP00000401125
  MOD_RES (1)..(1): Any amino acid
XEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTDDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQR

SEQ ID NO: 68285 - protein, 889 aa, Homo sapiens
  Payload ID: 13604
  Gene Symbol: PKN3
  Gene Name: protein kinase N3
  Uniprot ID: Q6P5Z2
  ENSP ID: ENSP00000291906
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 68286 - protein, 207 aa, Homo sapiens
  Payload ID: 13605
  Gene Symbol: PRKAA1
  Gene Name: protein kinase, AMP-activated, alpha 1 catalytic subunit
  ENSP ID: ENSP00000296800
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRDCNIIRILTSQFTNYQH

SEQ ID NO: 68287 - protein, 574 aa, Homo sapiens
  Payload ID: 13605
  Gene Symbol: PRKAA1
  Gene Name: protein kinase, AMP-activated, alpha 1 catalytic subunit
  Uniprot ID: Q13131
  ENSP ID: ENSP00000346148
MRRLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRKSDVPGVVKTGSTKELDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 68288 - protein, 559 aa, Homo sapiens
  Payload ID: 13605
  Gene Symbol: PRKAA1
  Gene Name: protein kinase, AMP-activated, alpha 1 catalytic subunit
  Uniprot ID: Q13131
  ENSP ID: ENSP00000380317
MRRLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 68289 - protein, 552 aa, Homo sapiens
  Payload ID: 13606
  Gene Symbol: PRKAA2
  Gene Name: protein kinase, AMP-activated, alpha 2 catalytic subunit
  Uniprot ID: P54646
  ENSP ID: ENSP00000360290
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 68290 - protein, 552 aa, Homo sapiens [sequence omitted]

SEQ ID NO: 68291 - protein, 270 aa, Homo sapiens
  Payload ID: 13607
  Gene Symbol: PRKAB1
  Gene Name: protein kinase, AMP-activated, beta 1 non-catalytic subunit
  Uniprot ID: Q9Y478
  ENSP ID: ENSP00000229328
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 68292 - protein, 62 aa, Homo sapiens
  Payload ID: 13607
  Gene Symbol: PRKAB1
  Gene Name: protein kinase, AMP-activated, beta 1 non-catalytic subunit
  ENSP ID: ENSP00000437993
MVDSQKCSDVSELSSSPPGPYHQEPYVCKPEERFRAPPILPPHLLQVILNKDTGISCDPALL

SEQ ID NO: 68293 - protein, 104 aa, Homo sapiens
  Payload ID: 13607
  Gene Symbol: PRKAB1
  Gene Name: protein kinase, AMP-activated, beta 1 non-catalytic subunit
  ENSP ID: ENSP00000439235
MVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 68294 - protein, 270 aa, Homo sapiens; identical to SEQ ID NO: 68291
  Payload ID: 13607
  Gene Symbol: PRKAB1
  Gene Name: protein kinase, AMP-activated, beta 1 non-catalytic subunit
  Uniprot ID: Q9Y478
  ENSP ID: ENSP00000441369

SEQ ID NO: 68295 - protein, 58 aa, Homo sapiens
  Payload ID: 13607
  Gene Symbol: PRKAB1
  Gene Name: protein kinase, AMP-activated, beta 1 non-catalytic subunit
  ENSP ID: ENSP00000444816
MGNTSSERAALERHGGHKTPRRDSSGGTKDGDRPKILMDSPEDADLFHSEEIKDGRRE

SEQ ID NO: 68296 - protein, 58 aa, Homo sapiens; identical to SEQ ID NO: 68295
  Payload ID: 13607
  Gene Symbol: PRKAB1
  Gene Name: protein kinase, AMP-activated, beta 1 non-catalytic subunit
  ENSP ID: ENSP00000486936

SEQ ID NO: 68297 - protein, 272 aa, Homo sapiens
  Payload ID: 13608
  Gene Symbol: PRKAB2
  Gene Name: protein kinase, AMP-activated, beta 2 non-catalytic subunit
  Uniprot ID: O43741
  ENSP ID: ENSP00000254101
MGNTTSDRVSGERHGAKAARSEGAGGHAPGKEHKIMVGSTDDPSVFSLPDSKLPGDKEFVSWQQDLEDSVKPTQQARPTVIRWSEGGKEVFISGSFNNWSTKIPLIKSHNDFVAILDLPEGEHQYKFFVDGQWVHDPSEPVVTSQLGTINNLIHVKKSDFEVFDALKLDSMESSETSCRDLSSSPPGPYGQEMYAFRSEERFKSPPILPPHLLQVILNKDTNISCDPALLPEPNHVMLNHLYALSIKDSVMVLSATHRYKKKYVTTLLYKPI

SEQ ID NO: 68298 - protein, 340 aa, Homo sapiens
  Payload ID: 13609
  Gene Symbol: PRKAG1
  Gene Name: protein kinase, AMP-activated, gamma 1 non-catalytic subunit
  Uniprot ID: P54619
  ENSP ID: ENSP00000323867
METVISSDSSPAVENEHPQETPESNNSVYTSFMKSHRCYDLIPTSSKLVVFDTSLQVKKAFFALVTNGVRAAPLWDSKKQSFVVLRALSCPLGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 68299 - protein, 93 aa, Homo sapiens
  Payload ID: 13609
  Gene Symbol: PRKAG1
  Gene Name: protein kinase, AMP-activated, gamma 1 non-catalytic subunit
  ENSP ID: ENSP00000446987
RVVDIYSKFDVINLAAEKTYNNLDVSVTKALQHRSHYFEGVLKCYLHETLETIINRLVEAEVHRLVVVDENDVVKGICPTHCLLEALWESDET

SEQ ID NO: 68300 - protein, 331 aa, Homo sapiens
  Payload ID: 13609
  Gene Symbol: PRKAG1
  Gene Name: protein kinase, AMP-activated, gamma 1 non-catalytic subunit
  Uniprot ID: P54619
  ENSP ID: ENSP00000447433
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 68301 - protein, 82 aa, Homo sapiens
  Payload ID: 13609
  Gene Symbol: PRKAG1
  Gene Name: protein kinase, AMP-activated, gamma 1 non-catalytic subunit
  ENSP ID: ENSP00000447637
METVISSDSSPAVENEHPQETPESNNSVYTSFMKSHRCYDLIPTSSKLVVFDTSLQSCPCGFAFMIITVLATGEESFFCFGD

SEQ ID NO: 68302 - protein, 202 aa, Homo sapiens
  Payload ID: 13609
  Gene Symbol: PRKAG1
  Gene Name: protein kinase, AMP-activated, gamma 1 non-catalytic subunit
  ENSP ID: ENSP00000447671
MSILKVKKAFFALVTNGVRAAPLWDSKKQSFVGMLTITDFINILHRYYKSALVQIYELEEHKIETWREVYLQDSFKPLVCISPNARSLSSPSQSSCPSLWKSYRLAPMPILLWFALPPPSMWLWGFLYSIESQPCQWWMRRNLAAEKTYNNLDVSVTKALQHRSHYFEGVLKCYLHETLETIINRLVEAEVHRLVVVDENDV

SEQ ID NO: 68303 - protein, 125 aa, Homo sapiens
  Payload ID: 13609
  Gene Symbol: PRKAG1
  Gene Name: protein kinase, AMP-activated, gamma 1 non-catalytic subunit
  ENSP ID: ENSP00000448251
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVID

SEQ ID NO: 68304 - protein, 69 aa, Homo sapiens
  Payload ID: 13609
  Gene Symbol: PRKAG1
  Gene Name: protein kinase, AMP-activated, gamma 1 non-catalytic subunit
  ENSP ID: ENSP00000448290
MKSHRCYDLIPTSSKLVVFDTSLQVKKAFFALVTNGVRAAPLWDSKKQSFVGMLTITDFINILHRYYKS

SEQ ID NO: 68305 - protein, 82 aa, Homo sapiens
  Payload ID: 13609
  Gene Symbol: PRKAG1
  Gene Name: protein kinase, AMP-activated, gamma 1 non-catalytic subunit
  ENSP ID: ENSP00000448739
MKSHRCYDLIPTSSKLVVFDTSLQVKKAFFALVTNGVRAAPLWDSKKQSFVGMLTITDFINILHRYYKSALVQIYELEEHKI

SEQ ID NO: 68306 - protein, 280 aa, Homo sapiens
  Payload ID: 13609
  Gene Symbol: PRKAG1
  Gene Name: protein kinase, AMP-activated, gamma 1 non-catalytic subunit
  ENSP ID: ENSP00000448873
MSILKVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 68307 - protein, 299 aa, Homo sapiens
  Payload ID: 13609
  Gene Symbol: PRKAG1
  Gene Name: protein kinase, AMP-activated, gamma 1 non-catalytic subunit
  Uniprot ID: P54619
  ENSP ID: ENSP00000448972
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 68308 - protein, 28 aa, Homo sapiens
  Payload ID: 13609
  Gene Symbol: PRKAG1
  Gene Name: protein kinase, AMP-activated, gamma 1 non-catalytic subunit
  ENSP ID: ENSP00000449104
MLTITDFINILHRYYKSALVQIYELEEH

SEQ ID NO: 68309 - protein, 251 aa, Homo sapiens
  Payload ID: 13609
  Gene Symbol: PRKAG1
  Gene Name: protein kinase, AMP-activated, gamma 1 non-catalytic subunit
  ENSP ID: ENSP00000449121
NSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNARSLSSPSQSSCPSLWKSYRLAPMPILLWFALPPPSMWLWGFLYSIESQPCQWWMRRNLAAEKTYNNLDVSVTKALQHRSHYFEGVLKCYLHETLETIINRLVEAEVHRLVVVDENDVVKGIVSLSDILQALVLTGGEKKP

SEQ ID NO: 68310 - protein, 161 aa, Homo sapiens
  Payload ID: 13609
  Gene Symbol: PRKAG1
  Gene Name: protein kinase, AMP-activated, gamma 1 non-catalytic subunit
  ENSP ID: ENSP00000449637
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSL

SEQ ID NO: 68311 - protein, 145 aa, Homo sapiens
  Payload ID: 13609
  Gene Symbol: PRKAG1
  Gene Name: protein kinase, AMP-activated, gamma 1 non-catalytic subunit
  ENSP ID: ENSP00000450112
MLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALP

SEQ ID NO: 68312 - protein, 43 aa, Homo sapiens
  Payload ID: 13609
  Gene Symbol: PRKAG1
  Gene Name: protein kinase, AMP-activated, gamma 1 non-catalytic subunit
  ENSP ID: ENSP00000450273
MFSLTGVMVISSDSSPAVENEHPQETPESNNSVYTSFMKSHRC

SEQ ID NO: 68313 - protein, 569 aa, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENSP ID: ENSP00000287878
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 68314 - protein, 525 aa, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENSP ID: ENSP00000376549
MPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 68315 - protein, 328 aa, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENSP ID: ENSP00000387386
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 68316 - protein, 52 aa, Homo sapiens
  Payload ID: 13610
  Gene Symbol: PRKAG2
  Gene Name: protein kinase, AMP-activated, gamma 2 non-catalytic subunit
  ENSP ID: ENSP00000417252
MLEKLEFEDEARCQGALIVCACHHALGGNPESYPQSRPFNHRLVPLSAPVKI

SEQ ID NO: 68317 - protein, 163 aa, Homo sapiens
  Payload ID: 13610
  Gene Symbol: PRKAG2
  Gene Name: protein kinase, AMP-activated, gamma 2 non-catalytic subunit
  ENSP ID: ENSP00000419493
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRI

SEQ ID NO: 68318 - protein, 445 aa, Homo sapiens
  Payload ID: 13610
  Gene Symbol: PRKAG2
  Gene Name: protein kinase, AMP-activated, gamma 2 non-catalytic subunit
  ENSP ID: ENSP00000419577
MKRFGSLRSNKKHKDQNRSTERRQSEPHGLFASGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 68319 - protein, 118 aa, Homo sapiens
  Payload ID: 13610
  Gene Symbol: PRKAG2
  Gene Name: protein kinase, AMP-activated, gamma 2 non-catalytic subunit
  ENSP ID: ENSP00000420645
MLTITDFINILHRYYKSPMVQIYELEEHKIETWRELYLQETFKPLVNISPDASLFDAVYSLIKNKIHRLPVIDPISGNALYILTHKRILKFLQLFVHQEDGINYTLYKRCLICQSLPS

SEQ ID NO: 68320 - protein, 229 aa, Homo sapiens
  Payload ID: 13610
  Gene Symbol: PRKAG2
  Gene Name: protein kinase, AMP-activated, gamma 2 non-catalytic subunit
  ENSP ID: ENSP00000420783
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAQ

SEQ ID NO: 68321 - protein, 489 aa, Homo sapiens
  Payload ID: 13611
  Gene Symbol: PRKAG3
  Gene Name: protein kinase, AMP-activated, gamma 3 non-catalytic subunit
  Uniprot ID: Q9UGI9
  ENSP ID: ENSP00000233944
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 68322 - protein, 489 aa, Homo sapiens; identical to SEQ ID NO: 68321
  Payload ID: 13611
  Gene Symbol: PRKAG3
  Gene Name: protein kinase, AMP-activated, gamma 3 non-catalytic subunit
  Uniprot ID: Q9UGI9
  ENSP ID: ENSP00000397133

SEQ ID NO: 68323 - protein, 100 aa, Homo sapiens
  Payload ID: 13611
  Gene Symbol: PRKAG3
  Gene Name: protein kinase, AMP-activated, gamma 3 non-catalytic subunit
  ENSP ID: ENSP00000416100
MEPGLEHALRRTPSWSSLGGSEHQEMSFLEQENSSSWPSPAVTSSSERIRGKRRAKALRWTRQKSVEEGEPPGPRSRPAAESTGLEATFPKTTPLAQADP

SEQ ID NO: 68324 - protein, 353 aa, Homo sapiens
  Payload ID: 13611
  Gene Symbol: PRKAG3
  Gene Name: protein kinase, AMP-activated, gamma 3 non-catalytic subunit
  ENSP ID: ENSP00000419272
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLRSTCKAASSLWSPSLLMIACLKLSTPSSRTGSIACLFLTRCQATYSTSSHTNACSSSCTSLVPCCPGPPSSTALSKIWASAHSETWLWCWRQHPS

SEQ ID NO: 68325 - protein, 489 aa, Homo sapiens; identical to SEQ ID NO: 68321
  Payload ID: 13611
  Gene Symbol: PRKAG3
  Gene Name: protein kinase, AMP-activated, gamma 3 non-catalytic subunit
  Uniprot ID: Q9UGI9
  ENSP ID: ENSP00000436068

SEQ ID NO: 68326 - protein, 351 aa, Homo sapiens
  Payload ID: 13612
  Gene Symbol: PRKACA
  Gene Name: protein kinase, cAMP-dependent, catalytic, alpha
  Uniprot ID: P17612
  ENSP ID: ENSP00000309591
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 68327 - protein, 207 aa, Homo sapiens
  Payload ID: 13612
  Gene Symbol: PRKACA
  Gene Name: protein kinase, cAMP-dependent, catalytic, alpha
  ENSP ID: ENSP00000466289
EFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKVGASPALPFP

SEQ ID NO: 68328 - protein, 343 aa, Homo sapiens
  Payload ID: 13612
  Gene Symbol: PRKACA
  Gene Name: protein kinase, cAMP-dependent, catalytic, alpha
  Uniprot ID: P17612
  ENSP ID: ENSP00000466651
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 68329 - protein, 25 aa, Homo sapiens
  Payload ID: 13612
  Gene Symbol: PRKACA
  Gene Name: protein kinase, cAMP-dependent, catalytic, alpha
  ENSP ID: ENSP00000466660
MLVKHKETGNHYAMKILDKQKVVKL

SEQ ID NO: 68330 - protein, 124 aa, Homo sapiens
  Payload ID: 13612
  Gene Symbol: PRKACA
  Gene Name: protein kinase, cAMP-dependent, catalytic, alpha
  ENSP ID: ENSP00000466976
MGNAAAAKKGSEQESVKEFLAKAKEDFLKKWESPAQPSQPTSACFKRVSQLQSDQVLLVYPGTGYGKRGSRLTPAPTHTPIPPNHRPHLLRANERSANLPFGVILPGKERFLVTCSVGCLLEFF

SEQ ID NO: 68331 - protein, 251 aa, Homo sapiens
  Payload ID: 13612
  Gene Symbol: PRKACA
  Gene Name: protein kinase, cAMP-dependent, catalytic, alpha
  ENSP ID: ENSP00000468352
  MOD_RES (1)..(1): Any amino acid
XIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVEAPFIPKFKGPGDTSNFDDYEEEEIRVSINEKCGKEFSEF

SEQ ID NO: 68332 - protein, 264 aa, Homo sapiens
  Payload ID: 13613
  Gene Symbol: PRKACB
  Gene Name: protein kinase, cAMP-dependent, catalytic, beta
  ENSP ID: ENSP00000359714
MSARKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKQNF

SEQ ID NO: 68333 - protein, 355 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000359716
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68334 - protein, 245 aa, Homo sapiens
  Payload ID: 13613
  Gene Symbol: PRKACB
  Gene Name: protein kinase, cAMP-dependent, catalytic, beta
  ENSP ID: ENSP00000359718
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 68335 - protein, 398 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000359719
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68336 - protein, 257 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000359722
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 68337 - protein, 351 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000359723
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68338 - protein, 357 aa, Homo sapiens
  Payload ID: 13613
  Gene Symbol: PRKACB
  Gene Name: protein kinase, cAMP-dependent, catalytic, beta
  ENSP ID: ENSP00000378314
MGLSRKSSDASACSSSEISDFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68339 - protein, 321 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000378315
MSARKSSDASACSSSEISVKEFLAKAKEDFLKKWENPTQNNAGLEDFERKKTLGTGSFGRVMLVKHKATEQYYAMKILDKQKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68340 - protein, 186 aa, Homo sapiens
  Payload ID: 13613
  Gene Symbol: PRKACB
  Gene Name: protein kinase, cAMP-dependent, catalytic, beta
  ENSP ID: ENSP00000390906
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQ

SEQ ID NO: 68341 - protein, 214 aa, Homo sapiens
  Payload ID: 13613
  Gene Symbol: PRKACB
  Gene Name: protein kinase, cAMP-dependent, catalytic, beta
  ENSP ID: ENSP00000392275
MGLSCSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNK

SEQ ID NO: 68342 - protein, 206 aa, Homo sapiens
  Payload ID: 13613
  Gene Symbol: PRKACB
  Gene Name: protein kinase, cAMP-dependent, catalytic, beta
  ENSP ID: ENSP00000393654
MSARKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTP

SEQ ID NO: 68343 - protein, 209 aa, Homo sapiens
  Payload ID: 13613
  Gene Symbol: PRKACB
  Gene Name: protein kinase, cAMP-dependent, catalytic, beta
  ENSP ID: ENSP00000397175
MSACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSK

SEQ ID NO: 68344 - protein, 197 aa, Homo sapiens
  Payload ID: 13613
  Gene Symbol: PRKACB
  Gene Name: protein kinase, cAMP-dependent, catalytic, beta
  ENSP ID: ENSP00000399326
MSVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEI

SEQ ID NO: 68345 - protein, 358 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000401252
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68346 - protein, 338 aa, Homo sapiens
  Payload ID: 13613
  Gene Symbol: PRKACB
  Gene Name: protein kinase, cAMP-dependent, catalytic, beta
  ENSP ID: ENSP00000479339
MLLLSSSISLYKDRNEARLISSQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68347 - protein, 357 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000479722
MSARKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68348 - protein, 339 aa, Homo sapiens
  Payload ID: 13613
  Gene Symbol: PRKACB
  Gene Name: protein kinase, cAMP-dependent, catalytic, beta
  Uniprot ID: P22694
  ENSP ID: ENSP00000481980
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 68349 - protein, 351 aa, Homo sapiens
  Payload ID: 13614
  Gene Symbol: PRKACG
  Gene Name: protein kinase, cAMP-dependent, catalytic, gamma
  Uniprot ID: P22612
  ENSP ID: ENSP00000366488
MGNAPAKKDTEQEESVNEFLAKARGDFLYRWGNPAQNTASSDQFERLRTLGMGSFGRVMLVRHQETGGHYAMKILNKQKVVKMKQVEHILNEKRILQAIDFPFLVKLQFSFKDNSYLYLVMEYVPGGEMFSRLQRVGRFSEPHACFYAAQVVLAVQYLHSLDLIHRDLKPENLLIDQQGYLQVTDFGFAKRVKGRTWTLCGTPEYLAPEIILSKGYNKAVDWWALGVLIYEMAVGFPPFYADQPIQIYEKIVSGRVRFPSKLSSDLKHLLRSLLQVDLTKRFGNLRNGVGDIKNHKWFATTSWIAIYEKKVEAPFIPKYTGPGDASNFDDYEEEELRISINEKCAKEFSEF

SEQ ID NO: 68350 - protein, 381 aa, Homo sapiens
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000351410
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 68351 - protein, 124 aa, Homo sapiens
  Payload ID: 13615
  Gene Symbol: PRKAR1A
  Gene Name: protein kinase, cAMP-dependent, regulatory, type I, alpha
  ENSP ID: ENSP00000376474
MESGSTAASEEARSLRECELYVQKHNIQALLKDSIVQLCTARPERPMAFLREYFERRRQNRFRICRKQALVQTQGRMRFLLLHPTQWLKVGGDEVLSALRSTRRKMRHPMLERLYQKITRQWPL

SEQ ID NO: 68352 - protein, 381 aa, Homo sapiens; identical to SEQ ID NO: 68350
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000376475

SEQ ID NO: 68353 - protein, 381 aa, Homo sapiens; identical to SEQ ID NO: 68350
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000445625

SEQ ID NO: 68354 - protein, 167 aa, Homo sapiens
  Payload ID: 13615
  Gene Symbol: PRKAR1A
  Gene Name: protein kinase, cAMP-dependent, regulatory, type I, alpha
  ENSP ID: ENSP00000464701
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQ

SEQ ID NO: 68355 - protein, 157 aa, Homo sapiens
  Payload ID: 13615
  Gene Symbol: PRKAR1A
  Gene Name: protein kinase, cAMP-dependent, regulatory, type I, alpha
  ENSP ID: ENSP00000464715
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVS

SEQ ID NO: 68356 - protein, 381 aa, Homo sapiens; identical to SEQ ID NO: 68350
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000464977

SEQ ID NO: 68357 - protein, 182 aa, Homo sapiens
  Payload ID: 13615
  Gene Symbol: PRKAR1A
  Gene Name: protein kinase, cAMP-dependent, regulatory, type I, alpha
  ENSP ID: ENSP00000465013
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGET

SEQ ID NO: 68358 - protein, 204 aa, Homo sapiens
  Payload ID: 13615
  Gene Symbol: PRKAR1A
  Gene Name: protein kinase, cAMP-dependent, regulatory, type I, alpha
  ENSP ID: ENSP00000465445
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELA

SEQ ID NO: 68359 - protein, 35 aa, Homo sapiens
  Payload ID: 13615
  Gene Symbol: PRKAR1A
  Gene Name: protein kinase, cAMP-dependent, regulatory, type I, alpha
  ENSP ID: ENSP00000465740
  MOD_RES (1)..(1): Any amino acid
XDRDSYRRILMGSTLRKRKMYEEFLSKVSILVGIN

SEQ ID NO: 68360 - protein, 153 aa, Homo sapiens
  Payload ID: 13615
  Gene Symbol: PRKAR1A
  Gene Name: protein kinase, cAMP-dependent, regulatory, type I, alpha
  ENSP ID: ENSP00000466314
  MOD_RES (1)..(1): Any amino acid
XGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGMYEFPHNKYMVSLSHLSVRYCSLP

SEQ ID NO: 68361 - protein, 381 aa, Homo sapiens; identical to SEQ ID NO: 68350
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000466459

SEQ ID NO: 68362 - protein, 113 aa, Homo sapiens
  Payload ID: 13615
  Gene Symbol: PRKAR1A
  Gene Name: protein kinase, cAMP-dependent, regulatory, type I, alpha
  ENSP ID: ENSP00000466649
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASY

SEQ ID NO: 68363 - protein, 131 aa, Homo sapiens
  Payload ID: 13615
  Gene Symbol: PRKAR1A
  Gene Name: protein kinase, cAMP-dependent, regulatory, type I, alpha
  ENSP ID: ENSP00000466722
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKFFSRLYQKITRQWPL

SEQ ID NO: 68364 - protein, 297 aa, Homo sapiens
  Payload ID: 13615
  Gene Symbol: PRKAR1A
  Gene Name: protein kinase, cAMP-dependent, regulatory, type I, alpha
  ENSP ID: ENSP00000467311
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILE

SEQ ID NO: 68365 - protein, 45 aa, Homo sapiens
  Payload ID: 13615
  Gene Symbol: PRKAR1A
  Gene Name: protein kinase, cAMP-dependent, regulatory, type I, alpha
  ENSP ID: ENSP00000467500
MESGSTAASEEARSLRECELYVQKHNIQALLKDSIVQLCTARPER

SEQ ID NO: 68366 - protein, 65 aa, Homo sapiens
  Payload ID: 13615
  Gene Symbol: PRKAR1A
  Gene Name: protein kinase, cAMP-dependent, regulatory, type I, alpha
  ENSP ID: ENSP00000467867
MESGSTAASEEARSLRECELYVQKHNIQALLKDSIVQLCTARPERPMAFLREYFERLEKEEAKQI

SEQ ID NO: 68367 - protein, 337 aa, Homo sapiens
  Payload ID: 13615
  Gene Symbol: PRKAR1A
  Gene Name: protein kinase, cAMP-dependent, regulatory, type I, alpha
  Uniprot ID: P10644
  ENSP ID: ENSP00000468106
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGHLIISRRSIPLG

SEQ ID NO: 68368 - protein, 381 aa, Homo sapiens
  Payload ID: 13616
  Gene Symbol: PRKAR1B
  Gene Name: protein kinase, cAMP-dependent, regulatory, type I, beta
  Uniprot ID: P31321
  ENSP ID: ENSP00000353415
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 68369 - protein, 242 aa, Homo sapiens
  Payload ID: 13616
  Gene Symbol: PRKAR1B
  Gene Name: protein kinase, cAMP-dependent, regulatory, type I, beta
  ENSP ID: ENSP00000383569
  MOD_RES (1)..(1): Any amino acid
XRPPHRGNAHHPRPGLVLIFSAGGHPPAPAPGPSRQHAEDFLGEVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 68370 - protein, 381 aa, Homo sapiens; identical to SEQ ID NO: 68368
  Payload ID: 13616
  Gene Symbol: PRKAR1B
  Gene Name: protein kinase, cAMP-dependent, regulatory, type I, beta
  Uniprot ID: P31321
  ENSP ID: ENSP00000385349

SEQ ID NO: 68371 - protein, 381 aa, Homo sapiens; identical to SEQ ID NO: 68368
  Payload ID: 13616
  Gene Symbol: PRKAR1B
  Gene Name: protein kinase, cAMP-dependent, regulatory, type I, beta
  Uniprot ID: P31321
  ENSP ID: ENSP00000385749

SEQ ID NO: 68372 - protein, 169 aa, Homo sapiens
  Payload ID: 13616
  Gene Symbol: PRKAR1B
  Gene Name: protein kinase, cAMP-dependent, regulatory, type I, beta
  ENSP ID: ENSP00000394633
MDPLEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLW

SEQ ID NO: 68373 - protein, 297 aa, Homo sapiens
  Payload ID: 13616
  Gene Symbol: PRKAR1B
  Gene Name: protein kinase, cAMP-dependent, regulatory, type I, beta
  ENSP ID: ENSP00000402648
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITE

SEQ ID NO: 68374 - protein, 165 aa, Homo sapiens
  Payload ID: 13616
  Gene Symbol: PRKAR1B
  Gene Name: protein kinase, cAMP-dependent, regulatory, type I, beta
  ENSP ID: ENSP00000406670
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVI

SEQ ID NO: 68375 - protein, 116 aa, Homo sapiens
  Payload ID: 13616
  Gene Symbol: PRKAR1B
  Gene Name: protein kinase, cAMP-dependent, regulatory, type I, beta
  ENSP ID: ENSP00000410414
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRK

SEQ ID NO: 68376 - protein, 381 aa, Homo sapiens; identical to SEQ ID NO: 68368
  Payload ID: 13616
  Gene Symbol: PRKAR1B
  Gene Name: protein kinase, cAMP-dependent, regulatory, type I, beta
  Uniprot ID: P31321
  ENSP ID: ENSP00000440449

SEQ ID NO: 68377 - protein, 381 aa, Homo sapiens; identical to SEQ ID NO: 68368
  Payload ID: 13616
  Gene Symbol: PRKAR1B
  Gene Name: protein kinase, cAMP-dependent, regulatory, type I, beta
  Uniprot ID: P31321
  ENSP ID: ENSP00000444487

SEQ ID NO: 68378 - protein, 404 aa, Homo sapiens
  Payload ID: 13617
  Gene Symbol: PRKAR2A
  Gene Name: protein kinase, cAMP-dependent, regulatory, type II, alpha
  Uniprot ID: P13861
  ENSP ID: ENSP00000265563
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 68379 - protein, 382 aa, Homo sapiens
  Payload ID: 13617
  Gene Symbol: PRKAR2A
  Gene Name: protein kinase, cAMP-dependent, regulatory, type II, alpha
  Uniprot ID: P13861
  ENSP ID: ENSP00000296446
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 68380 - protein, 404 aa, Homo sapiens; identical to SEQ ID NO: 68378
  Payload ID: 13617
  Gene Symbol: PRKAR2A
  Gene Name: protein kinase, cAMP-dependent, regulatory, type II, alpha
  Uniprot ID: P13861
  ENSP ID: ENSP00000394041

SEQ ID NO: 68381 - protein, 200 aa, Homo sapiens
  Payload ID: 13617
  Gene Symbol: PRKAR2A
  Gene Name: protein kinase, cAMP-dependent, regulatory, type II, alpha
  ENSP ID: ENSP00000400840
  MOD_RES (1)..(1): Any amino acid
XDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEDGQRFNPHLHFASEGPFIRPLVKITPTQFLYLWFKTACLSNNLSA

SEQ ID NO: 68382 - protein, 92 aa, Homo sapiens
  Payload ID: 13617
  Gene Symbol: PRKAR2A
  Gene Name: protein kinase, cAMP-dependent, regulatory, type II, alpha
  ENSP ID: ENSP00000409239
  MOD_RES (1)..(1): Any amino acid
XTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 68383 - protein, 114 aa, Homo sapiens
  Payload ID: 13617
  Gene Symbol: PRKAR2A
  Gene Name: protein kinase, cAMP-dependent, regulatory, type II, alpha
  ENSP ID: ENSP00000411432
MSHIQIPPGLTELLQGYTVEVLRQQPPDLVEFAVEYFTRLREARAPASVLPAATPRQSLGHPPPEPGPDRVADAKGDSESEEDEDLEVCAETYNPDEEEEDTDPRVIHPKTDEQ

SEQ ID NO: 68384 - protein, 99 aa, Homo sapiens
  Payload ID: 13617
  Gene Symbol: PRKAR2A
  Gene Name: protein kinase, cAMP-dependent, regulatory, type II, alpha
  ENSP ID: ENSP00000416438
  MOD_RES (1)..(1): Any amino acid
XDRVTFRRIIVKNNAKKRKMFESFIESVPLLKSLEVSERMKIVDVIGEKIYKDGERIITQGEKADSFYIIESGEVSILIRSRLWMYKHSRGFWGPAWTS

SEQ ID NO: 68385 - protein, 418 aa, Homo sapiens
  Payload ID: 13618
  Gene Symbol: PRKAR2B
  Gene Name: protein kinase, cAMP-dependent, regulatory, type II, beta
  Uniprot ID: P31323
  ENSP ID: ENSP00000265717
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 68386 - protein, 181 aa, Homo sapiens
  Payload ID: 13619
  Gene Symbol: PRKG1
  Gene Name: protein kinase, cGMP-dependent, type I
  ENSP ID: ENSP00000363087
SCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGWTWNLFEYVVE

SEQ ID NO: 68387 - protein, 686 aa, Homo sapiens
  Payload ID: 13619
  Gene Symbol: PRKG1
  Gene Name: protein kinase, cGMP-dependent, type I
  Uniprot ID: Q13976
  ENSP ID: ENSP00000363092
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 68388 - protein, 671 aa, Homo sapiens
  Payload ID: 13619
  Gene Symbol: PRKG1
  Gene Name: protein kinase, cGMP-dependent, type I
  Uniprot ID: Q13976
  ENSP ID: ENSP00000363097
MSELEEDFAKILMLKEERIKELEKRLSEKEEEIQELKRKLHKCQSVLPVPSTHIGPRTTRAQGISAEPQTYRSFHDLRQAFRKFTKSERSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 68389 - protein, 459 aa, Homo sapiens
  Payload ID: 13619
  Gene Symbol: PRKG1
  Gene Name: protein kinase, cGMP-dependent, type I
  ENSP ID: ENSP00000384200
MEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 68390 - protein, 762 aa, Homo sapiens
  Payload ID: 13620
  Gene Symbol: PRKG2
  Gene Name: protein kinase, cGMP-dependent, type II
  Uniprot ID: Q13237
  ENSP ID: ENSP00000264399
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 68391 - protein, 762 aa, Homo sapiens; identical to SEQ ID NO: 68390
  Payload ID: 13620
  Gene Symbol: PRKG2
  Gene Name: protein kinase, cGMP-dependent, type II
  Uniprot ID: Q13237
  ENSP ID: ENSP00000378945

SEQ ID NO: 68392 - protein, 342 aa, Homo sapiens
  Payload ID: 13620
  Gene Symbol: PRKG2
  Gene Name: protein kinase, cGMP-dependent, type II
  ENSP ID: ENSP00000439967
MSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 68393 - protein, 733 aa, Homo sapiens
  Payload ID: 13620
  Gene Symbol: PRKG2
  Gene Name: protein kinase, cGMP-dependent, type II
  Uniprot ID: Q13237
  ENSP ID: ENSP00000486129
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 68394 - protein, 4128 aa, Homo sapiens [sequence omitted]

SEQ ID NO: 68395 - protein, 4097 aa, Homo sapiens
  Payload ID: 13621
  Gene Symbol: PRKDC
  Gene Name: protein kinase, DNA-activated, catalytic polypeptide
  Uniprot ID: P78527
  ENSP ID: ENSP00000345182
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 68396 - protein, 70 aa, Homo sapiens
  Payload ID: 13621
  Gene Symbol: PRKDC
  Gene Name: protein kinase, DNA-activated, catalytic polypeptide
  ENSP ID: ENSP00000441157
MGQKIAPYSVEIKNTCTSVYTKDRAAKCKIPALDLLIKLLQTFRSSRLMDEFKIGELFSKFYGELALKKK

SEQ ID NO: 68397 - protein, 90 aa, Homo sapiens
  Payload ID: 13621
  Gene Symbol: PRKDC
  Gene Name: protein kinase, DNA-activated, catalytic polypeptide
  ENSP ID: ENSP00000442177
  MOD_RES (1)..(1): Any amino acid
XNNFMVAMETGGVIGIDFGHAFGSATQFLPVPELMPFRLTRQFINLMLPMKETGLMYSIMVHALRAFRSDPGLLTNTMDVFVKEPSFDWK

SEQ ID NO: 68398 - protein, 313 aa, Homo sapiens
  Payload ID: 13622
  Gene Symbol: PRKRA
  Gene Name: protein kinase, interferon-inducible double stranded RNA dependent activator
  Uniprot ID: O75569
  ENSP ID: ENSP00000318176
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 68399 - protein, 95 aa, Homo sapiens
  Payload ID: 13622
  Gene Symbol: PRKRA
  Gene Name: protein kinase, interferon-inducible double stranded RNA dependent activator
  ENSP ID: ENSP00000388455
MQSTPFCGFCSLGKMITAKPGKTPIQVLHEYGMKTKNIPVYECERSDVQIHVPTFTFRVTVGDITCTGEGTSKKLAKHRAAEAAINILKANASIW

SEQ ID NO: 68400 - protein, 302 aa, Homo sapiens
  Payload ID: 13622
  Gene Symbol: PRKRA
  Gene Name: protein kinase, interferon-inducible double stranded RNA dependent activator
  Uniprot ID: O75569
  ENSP ID: ENSP00000393883
MQSTPFCGFCSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 68401 - protein, 105 aa, Homo sapiens
  Payload ID: 13622
  Gene Symbol: PRKRA
  Gene Name: protein kinase, interferon-inducible double stranded RNA dependent activator
  ENSP ID: ENSP00000408029
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASI

SEQ ID NO: 68402 - protein, 108 aa, Homo sapiens
  Payload ID: 13622
  Gene Symbol: PRKRA
  Gene Name: protein kinase, interferon-inducible double stranded RNA dependent activator
  ENSP ID: ENSP00000408668
MQSTPFCGFCSLGKMITAKPGKTPIQVLHEYGMKTKNIPVYECERSDVQIHVPTFTFRVTVGDITCTGEGTSKKLAKHRAAEAAINILKANASIWNWLFIMAGDFLNI

SEQ ID NO: 68403 - protein, 288 aa, Homo sapiens
  Payload ID: 13622
  Gene Symbol: PRKRA
  Gene Name: protein kinase, interferon-inducible double stranded RNA dependent activator
  Uniprot ID: O75569
  ENSP ID: ENSP00000430604
MITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 68404 - protein, 499 aa, Homo sapiens
  Payload ID: 13623
  Gene Symbol: PKMYT1
  Gene Name: protein kinase, membrane associated tyrosine/threonine 1
  Uniprot ID: Q99640
  ENSP ID: ENSP00000262300
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 68405 - protein, 447 aa, Homo sapiens
  Payload ID: 13623
  Gene Symbol: PKMYT1
  Gene Name: protein kinase, membrane associated tyrosine/threonine 1
  ENSP ID: ENSP00000371675
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPCVLKRTEGALECSQMEGL

SEQ ID NO: 68406 - protein, 568 aa, Homo sapiens
  Payload ID: 13623
  Gene Symbol: PKMYT1
  Gene Name: protein kinase, membrane associated tyrosine/threonine 1
  ENSP ID: ENSP00000392855
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRVLTPLRLSPAAEPSAPGLGPAAEAPCCVEQRGFLSRHIPRSFSAFQAAPPKSACNALHLHGHTQPSAFVWSLTCSSHHGRTFEARTKVDPLFKICGGFLTVFADL

SEQ ID NO: 68407 - protein, 480 aa, Homo sapiens
  Payload ID: 13623
  Gene Symbol: PKMYT1
  Gene Name: protein kinase, membrane associated tyrosine/threonine 1
  Uniprot ID: Q99640
  ENSP ID: ENSP00000397739
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPGHPPCLACPPAGLHSPLRLSWPGLWGAPPPPGAGAHPGMPWT

SEQ ID NO: 68408 - protein, 274 aa, Homo sapiens
  Payload ID: 13623
  Gene Symbol: PKMYT1
  Gene Name: protein kinase, membrane associated tyrosine/threonine 1
  ENSP ID: ENSP00000458545
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSY

SEQ ID NO: 68409 - protein, 147 aa, Homo sapiens
  Payload ID: 13623
  Gene Symbol: PKMYT1
  Gene Name: protein kinase, membrane associated tyrosine/threonine 1
  ENSP ID: ENSP00000458842
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRG

SEQ ID NO: 68410 - protein, 490 aa, Homo sapiens
  Payload ID: 13623
  Gene Symbol: PKMYT1
  Gene Name: protein kinase, membrane associated tyrosine/threonine 1
  Uniprot ID: Q99640
  ENSP ID: ENSP00000458943
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 68411 - protein, 490 aa, Homo sapiens; identical to SEQ ID NO: 68410
  Payload ID: 13623
  Gene Symbol: PKMYT1
  Gene Name: protein kinase, membrane associated tyrosine/threonine 1
  Uniprot ID: Q99640
  ENSP ID: ENSP00000459123

SEQ ID NO: 68412 - protein, 60 aa, Homo sapiens
  Payload ID: 13623
  Gene Symbol: PKMYT1
  Gene Name: protein kinase, membrane associated tyrosine/threonine 1
  ENSP ID: ENSP00000459880
  MOD_RES (1)..(1): Any amino acid
XAEGGPCGRPCLPCSAGSGMGWLTLPAGYSPWARQPPRLAHHPAVCSWTAASPATGMTTA

SEQ ID NO: 68413 - protein, 215 aa, Homo sapiens
  Payload ID: 13623
  Gene Symbol: PKMYT1
  Gene Name: protein kinase, membrane associated tyrosine/threonine 1
  ENSP ID: ENSP00000460598
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKLLFPPRDTSKRSPGVSAGRPWLLRRWVSTDPARGMEVRSKEDGRLYAVKRSMSPFRGPKDRARKLAEVGSHEKVGQHPCCVRLEQAWEE

SEQ ID NO: 68414 - protein, 430 aa, Homo sapiens
  Payload ID: 13623
  Gene Symbol: PKMYT1
  Gene Name: protein kinase, membrane associated tyrosine/threonine 1
  Uniprot ID: Q99640
  ENSP ID: ENSP00000460868
MLERWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 68415 - protein, 169 aa, Homo sapiens
  Payload ID: 13623
  Gene Symbol: PKMYT1
  Gene Name: protein kinase, membrane associated tyrosine/threonine 1
  ENSP ID: ENSP00000461330
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPC

SEQ ID NO: 68416 - protein, 50 aa, Homo sapiens
  Payload ID: 13623
  Gene Symbol: PKMYT1
  Gene Name: protein kinase, membrane associated tyrosine/threonine 1
  ENSP ID: ENSP00000461628
MLERPPALAMPMPTEGTPPPLSGTPIPVPAYFRHAEPGFSLKRPRGLSRS

SEQ ID NO: 68417 - protein, 358 aa, Homo sapiens
  Payload ID: 13624
  Gene Symbol: PRKX
  Gene Name: protein kinase, X-linked
  Uniprot ID: P51817
  ENSP ID: ENSP00000262848
MEAPGLAQAAAAESDSRKVAEETPDGAPALCPSPEALSPEPPVYSLQDFDTLATVGTGTFGRVHLVKEKTAKHFFALKVMSIPDVIRLKQEQHVHNEKSVLKEVSHPFLIRLFWTWHDERFLYMLMEYVPGGELFSYLRNRGRFSSTTGLFYSAEIICAIEYLHSKEIVYRDLKPENILLDRDGHIKLTDFGFAKKLVDRTWTLCGTPEYLAPEVIQSKGHGRAVDWWALGILIFEMLSGFPPFFDDNPFGIYQKILAGKIDFPRHLDFHVKDLIKKLLVVDRTRRLGNMKNGANDVKHHRWFRSVDWEAVPQRKLKPPIVPKIAGDGDTSNFETYPENDWDTAAPVPQKDLEIFKNF

SEQ ID NO: 68418 - protein, 194 aa, Homo sapiens
  Payload ID: 13625
  Gene Symbol: POFUT1
  Gene Name: protein O-fucosyltransferase 1
  Uniprot ID: Q9H488
  ENSP ID: ENSP00000364882
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRRENHSCVTLLFPR

SEQ ID NO: 68419 - protein, 388 aa, Homo sapiens
  Payload ID: 13625
  Gene Symbol: POFUT1
  Gene Name: protein O-fucosyltransferase 1
  Uniprot ID: Q9H488
  ENSP ID: ENSP00000364902
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 68420 - protein, 424 aa, Homo sapiens
  Payload ID: 13626
  Gene Symbol: POFUT2
  Gene Name: protein O-fucosyltransferase 2
  Uniprot ID: Q9Y2G5
  ENSP ID: ENSP00000329682
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARCLPTSLSAESGSGGFQRFFCPKYSVSEQMVACVHSGHFHTVCLLV

SEQ ID NO: 68421 - protein, 380 aa, Homo sapiens
  Payload ID: 13626
  Gene Symbol: POFUT2
  Gene Name: protein O-fucosyltransferase 2
  Uniprot ID: Q9Y2G5
  ENSP ID: ENSP00000335427
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHASS

SEQ ID NO: 68422 - protein, 429 aa, Homo sapiens
  Payload ID: 13626
  Gene Symbol: POFUT2
  Gene Name: protein O-fucosyltransferase 2
  Uniprot ID: Q9Y2G5
  ENSP ID: ENSP00000339613
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 68423 - protein, 265 aa, Homo sapiens
  Payload ID: 13626
  Gene Symbol: POFUT2
  Gene Name: protein O-fucosyltransferase 2
  ENSP ID: ENSP00000407635
  MOD_RES (1)..(1): Any amino acid
XQFIAESGGPFIDQVYVLQSYAEGWKEGTWEEKVDERPCIDQLLYSQDKHEYYRDGGLVSPKCRLPLKALTLPGLLWKSCQLTASMCPVPGQLALKHGRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEEL

SEQ ID NO: 68424 - protein, 212 aa, Homo sapiens
  Payload ID: 13626
  Gene Symbol: POFUT2
  Gene Name: protein O-fucosyltransferase 2
  ENSP ID: ENSP00000478168
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAGRRTACGVCFVVSQCSARDKESGGPFIDQVYVLQSYAEGWKEGTWEEKVDERPCIDQLLYSQDKHEYYRCLLRLLPLPQRMVLGL

SEQ ID NO: 68425 - protein, 141 aa, Homo sapiens
  Payload ID: 13626
  Gene Symbol: POFUT2
  Gene Name: protein O-fucosyltransferase 2
  ENSP ID: ENSP00000482216
MVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHASS

SEQ ID NO: 68426 - protein, 392 aa, Homo sapiens
  Payload ID: 13627
  Gene Symbol: POGLUT1
  Gene Name: protein O-glucosyltransferase 1
  Uniprot ID: Q8NBL1
  ENSP ID: ENSP00000295588
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 68427 - protein, 187 aa, Homo sapiens
  Payload ID: 13627
  Gene Symbol: POGLUT1
  Gene Name: protein O-glucosyltransferase 1
  ENSP ID: ENSP00000419288
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTCFISCVASGQRPHLCCISHGLASFLESVWFHCLS

SEQ ID NO: 68428 - protein, 189 aa, Homo sapiens
  Payload ID: 13627
  Gene Symbol: POGLUT1
  Gene Name: protein O-glucosyltransferase 1
  ENSP ID: ENSP00000419865
  MOD_RES (1)..(1): Any amino acid
XCGAALPPAPQRGICSSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKK

SEQ ID NO: 68429 - protein, 163 aa, Homo sapiens
  Payload ID: 13627
  Gene Symbol: POGLUT1
  Gene Name: protein O-glucosyltransferase 1
  ENSP ID: ENSP00000419876
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKARLWKIGKIYL

SEQ ID NO: 68430 - protein, 111 aa, Homo sapiens
  Payload ID: 13627
  Gene Symbol: POGLUT1
  Gene Name: protein O-glucosyltransferase 1
  ENSP ID: ENSP00000420594
MEWWASSPLRLWLLLFLLPSAQGRQKESGGLRAVPSLPLGLGVWPESRGAPPRGRLPGRCRGRCSSELGRRHRGALRRRVQNGKYLLTKLTGLWRITNHVQVKTAAATMVS

SEQ ID NO: 68431 - protein, 660 aa, Homo sapiens
  Payload ID: 13628
  Gene Symbol: POMGNT1
  Gene Name: protein O-linked mannose N-acetylglucosaminyltransferase 1 (beta 1,2-)
  Uniprot ID: Q8WZA1
  ENSP ID: ENSP00000361052
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMVGVPASPYSVKKPPSVTPIFLEPPPKEEGAPGAPEQT

SEQ ID NO: 68432 - protein, 748 aa, Homo sapiens
  Payload ID: 13628
  Gene Symbol: POMGNT1
  Gene Name: protein O-linked mannose N-acetylglucosaminyltransferase 1 (beta 1,2-)
  Uniprot ID: Q8WZA1
  ENSP ID: ENSP00000361060
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMSEEATLSHPNFPGATPKGGGSPRSPRTDMRPPPGPCGAGPGSESNLFIDCPEGLENRPNLEGLDFFLGWNAALRVGLALTQETAVPNPWTGPAGAHMLTQTHSETLRHWTRPPLSLLFVQISKAG

SEQ ID NO: 68433 - protein, 200 aa, Homo sapiens
  Payload ID: 13628
  Gene Symbol: POMGNT1
  Gene Name: protein O-linked mannose N-acetylglucosaminyltransferase 1 (beta 1,2-)
  ENSP ID: ENSP00000379698
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKVLSSGRNILNHLPSLPGGTQSC

SEQ ID NO: 68434 - protein, 580 aa, Homo sapiens
  Payload ID: 13629
  Gene Symbol: POMGNT2
  Gene Name: protein O-linked mannose N-acetylglucosaminyltransferase 2 (beta 1,4-)
  Uniprot ID: Q8NAT1
  ENSP ID: ENSP00000344125
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 68435 - protein, 580 aa, Homo sapiens; identical to SEQ ID NO: 68434
  Payload ID: 13629
  Gene Symbol: POMGNT2
  Gene Name: protein O-linked mannose N-acetylglucosaminyltransferase 2 (beta 1,4-)
  Uniprot ID: Q8NAT1
  ENSP ID: ENSP00000408992

SEQ ID NO: 68436 - protein, 341 aa, Homo sapiens
  Payload ID: 13630
  Gene Symbol: PPP1CA
  Gene Name: protein phosphatase 1, catalytic subunit, alpha isozyme
  Uniprot ID: P62136
  ENSP ID: ENSP00000326031
MSDSEKLNLDSIIGRLLEGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 68437 - protein, 286 aa, Homo sapiens
  Payload ID: 13630
  Gene Symbol: PPP1CA
  Gene Name: protein phosphatase 1, catalytic subunit, alpha isozyme
  Uniprot ID: P62136
  ENSP ID: ENSP00000350974
MSDSEKLNLDSIIGRLLEGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 68438 - protein, 330 aa, Homo sapiens
  Payload ID: 13630
  Gene Symbol: PPP1CA
  Gene Name: protein phosphatase 1, catalytic subunit, alpha isozyme
  Uniprot ID: P62136
  ENSP ID: ENSP00000365936
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 68439 - protein, 253 aa, Homo sapiens
  Payload ID: 13630
  Gene Symbol: PPP1CA
  Gene Name: protein phosphatase 1, catalytic subunit, alpha isozyme
  ENSP ID: ENSP00000431146
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDET

SEQ ID NO: 68440 - protein, 179 aa, Homo sapiens
  Payload ID: 13630
  Gene Symbol: PPP1CA
  Gene Name: protein phosphatase 1, catalytic subunit, alpha isozyme
  ENSP ID: ENSP00000438409
MRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPGTAGWGTSATGAVQGSRPGKNVQLTENEIRGLCLKSREIFLSQPILLELEAPLKICGDIHGQYYDLLRLFEYGGFP

SEQ ID NO: 68441 - protein, 169 aa, Homo sapiens
  Payload ID: 13630
  Gene Symbol: PPP1CA
  Gene Name: protein phosphatase 1, catalytic subunit, alpha isozyme
  ENSP ID: ENSP00000439568
MRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPVQGSRPGKNVQLTENEIRGLCLKSREIFLSQPILLELEAPLKICGDIHGQYYDLLRLFEYGGFPPE

SEQ ID NO: 68442 - protein, 327 aa, Homo sapiens
  Payload ID: 13631
  Gene Symbol: PPP1CB
  Gene Name: protein phosphatase 1, catalytic subunit, beta isozyme
  Uniprot ID: P62140
  ENSP ID: ENSP00000296122
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 68443 - protein, 327 aa, Homo sapiens; identical to SEQ ID NO: 68442
  Payload ID: 13631
  Gene Symbol: PPP1CB
  Gene Name: protein phosphatase 1, catalytic subunit, beta isozyme
  Uniprot ID: P62140
  ENSP ID: ENSP00000351298

SEQ ID NO: 68444 - protein, 327 aa, Homo sapiens; identical to SEQ ID NO: 68442
  Payload ID: 13631
  Gene Symbol: PPP1CB
  Gene Name: protein phosphatase 1, catalytic subunit, beta isozyme
  Uniprot ID: P62140
  ENSP ID: ENSP00000378769

SEQ ID NO: 68445 - protein, 82 aa, Homo sapiens
  Payload ID: 13631
  Gene Symbol: PPP1CB
  Gene Name: protein phosphatase 1, catalytic subunit, beta isozyme
  ENSP ID: ENSP00000388056
CASINRIYGFYDECKRRFNIKLWKTFTDCFNCLPIAAIVDEKIFCCHGGRLVNLPYRFFFSSIIRKIPIIIKRLWENKAVLV

SEQ ID NO: 68446 - protein, 169 aa, Homo sapiens
  Payload ID: 13631
  Gene Symbol: PPP1CB
  Gene Name: protein phosphatase 1, catalytic subunit, beta isozyme
  ENSP ID: ENSP00000390715
MTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDT

SEQ ID NO: 68447 - protein, 64 aa, Homo sapiens
  Payload ID: 13631
  Gene Symbol: PPP1CB
  Gene Name: protein phosphatase 1, catalytic subunit, beta isozyme
  ENSP ID: ENSP00000394589
MTEAEVRGLCIKSREIFLSQPILLELEAPLKICGIQEQLSGSSGSGSLTRLQLRRDLGLQSSEG

SEQ ID NO: 68448 - protein, 125 aa, Homo sapiens
  Payload ID: 13631
  Gene Symbol: PPP1CB
  Gene Name: protein phosphatase 1, catalytic subunit, beta isozyme
  ENSP ID: ENSP00000398839
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHE

SEQ ID NO: 68449 - protein, 138 aa, Homo sapiens
  Payload ID: 13631
  Gene Symbol: PPP1CB
  Gene Name: protein phosphatase 1, catalytic subunit, beta isozyme
  ENSP ID: ENSP00000414918
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDE

SEQ ID NO: 68450 - protein, 323 aa, Homo sapiens
  Payload ID: 13632
  Gene Symbol: PPP1CC
  Gene Name: protein phosphatase 1, catalytic subunit, gamma isozyme
  Uniprot ID: P36873
  ENSP ID: ENSP00000335084
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 68451 - protein, 337 aa, Homo sapiens
  Payload ID: 13632
  Gene Symbol: PPP1CC
  Gene Name: protein phosphatase 1, catalytic subunit, gamma isozyme
  Uniprot ID: P36873
  ENSP ID: ENSP00000341779
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRVASGLNPSIQKASNYRNNTVLYE

SEQ ID NO: 68452 - protein, 83 aa, Homo sapiens
  Payload ID: 13632
  Gene Symbol: PPP1CC
  Gene Name: protein phosphatase 1, catalytic subunit, gamma isozyme
  ENSP ID: ENSP00000447090
NCLPIAAIVDEKIFCCHGGLSPDLQSMEQIRRIMRPTDVPDQDFKACREKEAKCHETCNASKGYDHKASKEIDVVLTLPSRDL

SEQ ID NO: 68453 - protein, 332 aa, Homo sapiens
  Payload ID: 13632
  Gene Symbol: PPP1CC
  Gene Name: protein phosphatase 1, catalytic subunit, gamma isozyme
  ENSP ID: ENSP00000447122
MFLPLYLNLVLYFVFWLHWTNCDFSLAVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 68454 - protein, 54 aa, Homo sapiens
  Payload ID: 13632
  Gene Symbol: PPP1CC
  Gene Name: protein phosphatase 1, catalytic subunit, gamma isozyme
  ENSP ID: ENSP00000447528
  MOD_RES (1)..(1): Any amino acid
XIHGQYYDLLRLFEYGGFPPESNYLFLGDYVDRGKQFITRSSIYGADSANYATN

SEQ ID NO: 68455 - protein, 270 aa, Homo sapiens
  Payload ID: 13632
  Gene Symbol: PPP1CC
  Gene Name: protein phosphatase 1, catalytic subunit, gamma isozyme
  ENSP ID: ENSP00000448437
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVLILNFTCTLKSMCVSTDSPC

SEQ ID NO: 68456 - protein, 304 aa, Homo sapiens
  Payload ID: 13632
  Gene Symbol: PPP1CC
  Gene Name: protein phosphatase 1, catalytic subunit, gamma isozyme
  ENSP ID: ENSP00000448981
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQVEHAFNMISF

SEQ ID NO: 68457 - protein, 140 aa, Homo sapiens
  Payload ID: 13632
  Gene Symbol: PPP1CC
  Gene Name: protein phosphatase 1, catalytic subunit, gamma isozyme
  ENSP ID: ENSP00000482210
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDEC

SEQ ID NO: 68458 - protein, 74 aa, Homo sapiens
  Payload ID: 13633
  Gene Symbol: PPP1R11
  Gene Name: protein phosphatase 1, regulatory (inhibitor) subunit 11
  ENSP ID: ENSP00000365949
MGRRSSKCCCIYEKPRAFGESSTESDEEEEEGCGHTHCVRGHRKGRRRATLGPTPTTPPQPPDPSQPPPGPMQH

SEQ ID NO: 68459 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000365954

SEQ ID NO: 68460 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000365956

SEQ ID NO: 68461 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000365960

SEQ ID NO: 68462 - protein, 126 aa, Homo sapiens
  Payload ID: 13633
  Gene Symbol: PPP1R11
  Gene Name: protein phosphatase 1, regulatory (inhibitor) subunit 11
  Uniprot ID: O60927
  ENSP ID: ENSP00000365963
MAEAGAGLSETVTETTVTVTTEPENRSLTIKLRKRKPEKKVEWTSDTVDNEHMGRRSSKCCCIYEKPRAFGESSTESDEEEEEGCGHTHCVRGHRKGRRRATLGPTPTTPPQPPDPSQPPPGPMQH

SEQ ID NO: 68463 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000365964

SEQ ID NO: 68464 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000373107

SEQ ID NO: 68465 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000383495

SEQ ID NO: 68466 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000383496

SEQ ID NO: 68467 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000383497

SEQ ID NO: 68468 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000383498

SEQ ID NO: 68469 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000383499

SEQ ID NO: 68470 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000388044

SEQ ID NO: 68471 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000390548

SEQ ID NO: 68472 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000390917

SEQ ID NO: 68473 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000391581

SEQ ID NO: 68474 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000392044

SEQ ID NO: 68475 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000392260

SEQ ID NO: 68476 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000394056

SEQ ID NO: 68477 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000396522

SEQ ID NO: 68478 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000397132

SEQ ID NO: 68479 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000398205

SEQ ID NO: 68480 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000399167

SEQ ID NO: 68481 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000399222

SEQ ID NO: 68482 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000399723

SEQ ID NO: 68483 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000399965

SEQ ID NO: 68484 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000400589

SEQ ID NO: 68485 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000400763

SEQ ID NO: 68486 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000401267

SEQ ID NO: 68487 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000403557

SEQ ID NO: 68488 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000403611

SEQ ID NO: 68489 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000404779

SEQ ID NO: 68490 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000404824

SEQ ID NO: 68491 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000406410

SEQ ID NO: 68492 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000406648

SEQ ID NO: 68493 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000407981

SEQ ID NO: 68494 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000408173

SEQ ID NO: 68495 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000409066

SEQ ID NO: 68496 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000410429

SEQ ID NO: 68497 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000411038

SEQ ID NO: 68498 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000411693

SEQ ID NO: 68499 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000411976

SEQ ID NO: 68500 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000412297

SEQ ID NO: 68501 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000412526

SEQ ID NO: 68502 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000414471

SEQ ID NO: 68503 - protein, 126 aa, Homo sapiens; identical to SEQ ID NO: 68462
  Payload ID: 13633
  Gene Symbol: PPP1R11
  Gene Name: protein phosphatase 1, regulatory (inhibitor) subunit 11
  Uniprot ID: O60927
  ENSP ID: ENSP00000414808

SEQ ID NO: 68504 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000415651

SEQ ID NO: 68505 - protein, 74 aa, Homo sapiens; identical to SEQ ID NO: 68458
  Payload ID: 13633
  Gene Symbol: PPP1R11
  Gene Name: protein phosphatase 1, regulatory (inhibitor) subunit 11
  ENSP ID: ENSP00000416038

SEQ ID NO: 68506 - protein, 147 aa, Homo sapiens
  Payload ID: 13634
  Gene Symbol: PPP1R14A
  Gene Name: protein phosphatase 1, regulatory (inhibitor) subunit 14A
  Uniprot ID: Q96A00
  ENSP ID: ENSP00000301242
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEDFIQELLAKLQGLHRQPGLRQPSPSHDGSLSPLQDRARTAHP

SEQ ID NO: 68507 - protein, 120 aa, Homo sapiens
  Payload ID: 13634
  Gene Symbol: PPP1R14A
  Gene Name: protein phosphatase 1, regulatory (inhibitor) subunit 14A
  Uniprot ID: Q96A00
  ENSP ID: ENSP00000301243
MAAQRLGKRVLSKLQSPSRARGPGGSPGGLQKRHARVTVKYDRRELQRRLDVEKWIDGRLEELYRGMGLLKSCGKPVEDFIQELLAKLQGLHRQPGLRQPSPSHDGSLSPLQDRARTAHP

SEQ ID NO: 68508 - protein, 121 aa, Homo sapiens
  Payload ID: 13634
  Gene Symbol: PPP1R14A
  Gene Name: protein phosphatase 1, regulatory (inhibitor) subunit 14A
  ENSP ID: ENSP00000465104
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEVSFLSLILSLFWPQVL

SEQ ID NO: 68509 - protein, 77 aa, Homo sapiens
  Payload ID: 13634
  Gene Symbol: PPP1R14A
  Gene Name: protein phosphatase 1, regulatory (inhibitor) subunit 14A
  ENSP ID: ENSP00000465811
MPDEINIDELLELESEEERSRKIQGLLKSCGKPVEDFIQELLAKLQGLHRQPGLRQPSPSHDGSLSPLQDRARTAHP

SEQ ID NO: 68510 - protein, 123 aa, Homo sapiens
  Payload ID: 13634
  Gene Symbol: PPP1R14A
  Gene Name: protein phosphatase 1, regulatory (inhibitor) subunit 14A
  ENSP ID: ENSP00000466572
MAAQRLGKRVLSKLQSPSRARGPGGSPGGLQKRHARVTVKYDRRELQRRLDVEKWIDGRLEELYRGMEADMPDEINIDELLELESEEERSRKIQPPPGPGPDCSPLTLLHSPCPPDAAQLACV

SEQ ID NO: 68511 - protein, 147 aa, Homo sapiens
  Payload ID: 13635
  Gene Symbol: PPP1R14B
  Gene Name: protein phosphatase 1, regulatory (inhibitor) subunit 14B
  Uniprot ID: Q96C90
  ENSP ID: ENSP00000310117
MADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 68512 - protein, 72 aa, Homo sapiens
  Payload ID: 13635
  Gene Symbol: PPP1R14B
  Gene Name: protein phosphatase 1, regulatory (inhibitor) subunit 14B
  ENSP ID: ENSP00000439333
MSLPPPPPPPQEEEIPELEIDVDELLDMESDDARAARVKELLVDCYKPTEAFISGLLDKIRGMQKLSTPQKK

SEQ ID NO: 68513 - protein, 45 aa, Homo sapiens
  Payload ID: 13635
  Gene Symbol: PPP1R14B
  Gene Name: protein phosphatase 1, regulatory (inhibitor) subunit 14B
  ENSP ID: ENSP00000441067
MESDDARAARVKELLVDCYKPTEAFISGLLDKIRGMQKLSTPQKK

SEQ ID NO: 68514 - protein, 165 aa, Homo sapiens
  Payload ID: 13636
  Gene Symbol: PPP1R14C
  Gene Name: protein phosphatase 1, regulatory (inhibitor) subunit 14C
  Uniprot ID: Q8TAE6
  ENSP ID: ENSP00000355260
MSVATGSSETAGGASGGGARVFFQSPRGGAGGSPGSSSGSGSSREDSAPVATAAAAGQVQQQQQRRHQQGKVTVKYDRKELRKRLVLEEWIVEQLGQLYGCEEEEMPEVEIDIDDLLDADSDEERASKLQEALVDCYKPTEEFIKELLSRIRGMRKLSPPQKKSV

SEQ ID NO: 68515 - protein, 145 aa, Homo sapiens
  Payload ID: 13637
  Gene Symbol: PPP1R14D
  Gene Name: protein phosphatase 1, regulatory (inhibitor) subunit 14D
  Uniprot ID: Q9NXH3
  ENSP ID: ENSP00000299174
MLSSSPASCTSPSPDGENPCKKVHWASGRRRTSSTDSESKSHPDSSKIPRSRRPSRLTVKYDRGQLQRWLEMEQWVDAQVQELFQDQATPSEPEIDLEALMDLSTEEQKTQLEAILGNCPRPTEAFISELLSQLKKLRRLSRPQK

SEQ ID NO: 68516 - protein, 200 aa, Homo sapiens
  Payload ID: 13637
  Gene Symbol: PPP1R14D
  Gene Name: protein phosphatase 1, regulatory (inhibitor) subunit 14D
  ENSP ID: ENSP00000398342
MLSSSPASCTSPSPDGENPCKKVHWASGRRRTSSTDSESKSHPDSSKIPRSRRPSRLTVKYDRGQLQRWLEMEQWVDAQVQELFQSLALSPRLECSGVIHSLQLLPPGFNRFSCLSSWSSWDYGIKQPLLSLRLTWKLSWIYPQRSRRLSWRPFLGTAPAPQRLLSLSCSVNSRNSGDSAGLRNKPERPSLAASALPGLP

SEQ ID NO: 68517 - protein, 171 aa, Homo sapiens
  Payload ID: 13638
  Gene Symbol: PPP1R1A
  Gene Name: protein phosphatase 1, regulatory (inhibitor) subunit 1A
  Uniprot ID: Q13522
  ENSP ID: ENSP00000257905
MEQDNSPRKIQFTVPLLEPHLDPEAAEQIRRRRPTPATLVLTSDQSSPEIDEDRIPNPHLKSTLAMSPRQRKKMTRITPTMKELQMMVEHHLGQQQQGEEPEGAAESTGTQESRPPGIPDTEVESRLGTSGTAKKTAECIPKTHERGSKEPSTKEPSTHIPPLDSKGANSV

SEQ ID NO: 68518 - protein, 64 aa, Homo sapiens
  Payload ID: 13638
  Gene Symbol: PPP1R1A
  Gene Name: protein phosphatase 1, regulatory (inhibitor) subunit 1A
  ENSP ID: ENSP00000448559
MEQDNSPRKIQFTVPLLEPHLDPEAAEQIRRRRPTPATLVLTSDQSSPEIDEDRIPNPHLKSSR

SEQ ID NO: 68519 - protein, 90 aa, Homo sapiens
  Payload ID: 13638
  Gene Symbol: PPP1R1A
  Gene Name: protein phosphatase 1, regulatory (inhibitor) subunit 1A
  ENSP ID: ENSP00000450178
  MOD_RES (1)..(1): Any amino acid
XRRRPTPATLVLTSDQSSPEIDEDRIPNPHLKSTLAMSPRQRKKMTRITPTMKETAECIPKTHERGSKEPSTKEPSTHIPPLDSKGANSV

SEQ ID NO: 68520 - protein, 153 aa, Homo sapiens
  Payload ID: 13638
  Gene Symbol: PPP1R1A
  Gene Name: protein phosphatase 1, regulatory (inhibitor) subunit 1A
  ENSP ID: ENSP00000473304
MEQDNSPRKIQFTVPLLEPHLDPEAAEQIRRRRPTPATLVLTSDQSSPEIDEDRIPNPHLKKLQNASLKLTREAVRNPAQKNPQPIYHHWIPREPTRSERGGGTGGQKSVGGFPCSTHTLAPFYVFTRSILLLKRGERMSHPLEPRDDPTKMP

SEQ ID NO: 68521 - protein, 204 aa, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENSP ID: ENSP00000254079
MDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 68522 - protein, 168 aa, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENSP ID: ENSP00000377808
MLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 68523 - protein, 168 aa, Homo sapiens; identical to SEQ ID NO: 68522
  Payload ID: 13639
  Gene Symbol: PPP1R1B
  Gene Name: protein phosphatase 1, regulatory (inhibitor) subunit 1B
  Uniprot ID: Q9UD71
  ENSP ID: ENSP00000377810

SEQ ID NO: 68524 - protein, 204 aa, Homo sapiens; identical to SEQ ID NO: 68521
  Payload ID: 13639
  Gene Symbol: PPP1R1B
  Gene Name: protein phosphatase 1, regulatory (inhibitor) subunit 1B
  Uniprot ID: Q9UD71
  ENSP ID: ENSP00000462137

SEQ ID NO: 68525 - protein, 144 aa, Homo sapiens
  Payload ID: 13639
  Gene Symbol: PPP1R1B
  Gene Name: protein phosphatase 1, regulatory (inhibitor) subunit 1B
  ENSP ID: ENSP00000462522
MDPKDRKKIQFSVPAPPSQLDPRQIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQ

SEQ ID NO: 68526 - protein, 171 aa, Homo sapiens
  Payload ID: 13639
  Gene Symbol: PPP1R1B
  Gene Name: protein phosphatase 1, regulatory (inhibitor) subunit 1B
  ENSP ID: ENSP00000462841
MDPKDRKKIQFSVPAPPSQLDPRQVEMIRRRRPTPAMLFRLSEHSSPAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 68527 - protein, 116 aa, Homo sapiens
  Payload ID: 13640
  Gene Symbol: PPP1R1C
  Gene Name: protein phosphatase 1, regulatory (inhibitor) subunit 1C
  Uniprot ID: Q8WVI7
  ENSP ID: ENSP00000280295
MEPNSPKKIQFAVPVFQSQIAPEAAEQLGFCRSQIRKRRPTPASLVILNEHNPPEIDDKRGPNTQGELQNASPKQRKQSVYTPPTIKGVKHLKGQNESAFPEEEEGTNEREEQRDH

SEQ ID NO: 68528 - protein, 109 aa, Homo sapiens
  Payload ID: 13640
  Gene Symbol: PPP1R1C
  Gene Name: protein phosphatase 1, regulatory (inhibitor) subunit 1C
  Uniprot ID: Q8WVI7
  ENSP ID: ENSP00000386359
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 68529 - protein, 109 aa, Homo sapiens; identical to SEQ ID NO: 68528
  Payload ID: 13640
  Gene Symbol: PPP1R1C
  Gene Name: protein phosphatase 1, regulatory (inhibitor) subunit 1C
  Uniprot ID: Q8WVI7
  ENSP ID: ENSP00000386778

SEQ ID NO: 68530 - protein, 170 aa, Homo sapiens
  Payload ID: 13641
  Gene Symbol: PPP1R2
  Gene Name: protein phosphatase 1, regulatory (inhibitor) subunit 2
  ENSP ID: ENSP00000400238
MAASTASHRPIKGILKNKTSTTSSMVASAEQPRGNVDEELSKKSQKWDEMNILATYHPADKDYGLMKIDEPSTPYHRLAAAEGLEPKYRIQEQESSGEEDSDLSPEEREKKRQFEMKRKLHYNEGLNIKLARQLISKDLHDDDEDEEMLETADGESMNTEESNQGSTPSD

SEQ ID NO: 68531 - protein, 80 aa, Homo sapiens
  Payload ID: 13641
  Gene Symbol: PPP1R2
  Gene Name: protein phosphatase 1, regulatory (inhibitor) subunit 2
  ENSP ID: ENSP00000406725
MAASTASHRPIKGILKNKTSTTSSMVASAEQPRGNVDEELSKKSQKWDEMNILATYHPADKDYGLMKIDEPSTPYHRYIL

SEQ ID NO: 68532 - protein, 54 aa, Homo sapiens
  Payload ID: 13641
  Gene Symbol: PPP1R2
  Gene Name: protein phosphatase 1, regulatory (inhibitor) subunit 2
  ENSP ID: ENSP00000415175
TYHPADKDYGLMKIDEPSTPYHSMMGDDEDACSDTEATEAMAPDILARKKKATI

SEQ ID NO: 68533 - protein, 205 aa, Homo sapiens
  Payload ID: 13641
  Gene Symbol: PPP1R2
  Gene Name: protein phosphatase 1, regulatory (inhibitor) subunit 2
  Uniprot ID: P41236
  ENSP ID: ENSP00000484580
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 68534 - protein, 80 aa, Homo sapiens; identical to SEQ ID NO: 68531
  Payload ID: 13641
  Gene Symbol: PPP1R2
  Gene Name: protein phosphatase 1, regulatory (inhibitor) subunit 2
  ENSP ID: ENSP00000486328

SEQ ID NO: 68535 - protein, 940 aa, Homo sapiens
  Payload ID: 13642
  Gene Symbol: PPP1R10
  Gene Name: protein phosphatase 1, regulatory subunit 10
  Uniprot ID: Q96QC0
  ENSP ID: ENSP00000365694
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 68536 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000373080

SEQ ID NO: 68537 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000389299

SEQ ID NO: 68538 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000407181

SEQ ID NO: 68539 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000407310

SEQ ID NO: 68540 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000413554

SEQ ID NO: 68541 - protein, 940 aa, Homo sapiens; identical to SEQ ID NO: 68535
  Payload ID: 13642
  Gene Symbol: PPP1R10
  Gene Name: protein phosphatase 1, regulatory subunit 10
  Uniprot ID: Q96QC0
  ENSP ID: ENSP00000416060

SEQ ID NO: 68542 - protein, 1030 aa, Homo sapiens
  Payload ID: 13643
  Gene Symbol: PPP1R12A
  Gene Name: protein phosphatase 1, regulatory subunit 12A
  Uniprot ID: O14974
  ENSP ID: ENSP00000261207
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 68543 - protein, 1030 aa, Homo sapiens; identical to SEQ ID NO: 68542
  Payload ID: 13643
  Gene Symbol: PPP1R12A
  Gene Name: protein phosphatase 1, regulatory subunit 12A
  Uniprot ID: O14974
  ENSP ID: ENSP00000389168

SEQ ID NO: 68544 - protein, 995 aa, Homo sapiens
  Payload ID: 13643
  Gene Symbol: PPP1R12A
  Gene Name: protein phosphatase 1, regulatory subunit 12A
  Uniprot ID: O14974
  ENSP ID: ENSP00000416769
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKRQERFADRSLLEMEKRERRALERRISEMEEELKMLPDLKADNQRLKDENGALIRVISKLSK

SEQ ID NO: 68545 - protein, 692 aa, Homo sapiens
  Payload ID: 13643
  Gene Symbol: PPP1R12A
  Gene Name: protein phosphatase 1, regulatory subunit 12A
  ENSP ID: ENSP00000446816
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSRSYLTPVRDEESESQRKARSRQARQSRRSTQGVTLTDLQEAEKTIGRSRSTRTREQENEEKEKEEKEKQDKEKQEEKKESETSRE

SEQ ID NO: 68546 - protein, 974 aa, Homo sapiens
  Payload ID: 13643
  Gene Symbol: PPP1R12A
  Gene Name: protein phosphatase 1, regulatory subunit 12A
  Uniprot ID: O14974
  ENSP ID: ENSP00000446855
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 68547 - protein, 367 aa, Homo sapiens
  Payload ID: 13643
  Gene Symbol: PPP1R12A
  Gene Name: protein phosphatase 1, regulatory subunit 12A
  ENSP ID: ENSP00000447144
  MOD_RES (1)..(1): Any amino acid
XPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTS

SEQ ID NO: 68548 - protein, 210 aa, Homo sapiens
  Payload ID: 13643
  Gene Symbol: PPP1R12A
  Gene Name: protein phosphatase 1, regulatory subunit 12A
  ENSP ID: ENSP00000447338
GLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVLHSEKRDKKSPLIESTAN

SEQ ID NO: 68549 - protein, 943 aa, Homo sapiens
  Payload ID: 13643
  Gene Symbol: PPP1R12A
  Gene Name: protein phosphatase 1, regulatory subunit 12A
  Uniprot ID: O14974
  ENSP ID: ENSP00000449514
MVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 68550 - protein, 161 aa, Homo sapiens
  Payload ID: 13643
  Gene Symbol: PPP1R12A
  Gene Name: protein phosphatase 1, regulatory subunit 12A
  ENSP ID: ENSP00000449647
ESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISSPVRPVINFCLLMILLN

SEQ ID NO: 68551 - protein, 188 aa, Homo sapiens
  Payload ID: 13643
  Gene Symbol: PPP1R12A
  Gene Name: protein phosphatase 1, regulatory subunit 12A
  ENSP ID: ENSP00000449666
  MOD_RES (1)..(1): Any amino acid
XEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRVTGKSQYLLGGTKSSRKKNI

SEQ ID NO: 68552 - protein, 97 aa, Homo sapiens
  Payload ID: 13643
  Gene Symbol: PPP1R12A
  Gene Name: protein phosphatase 1, regulatory subunit 12A
  ENSP ID: ENSP00000449843
MEELLQNEVNRQGVDIEAARKEEERIMLRDARQWLNSGHINDVRHAKSGGTALHVAAAKGYTEVLKLLIQAGYDVNIKDYDGWTPLHAAAHWGKEEA

SEQ ID NO: 68553 - protein, 234 aa, Homo sapiens
  Payload ID: 13643
  Gene Symbol: PPP1R12A
  Gene Name: protein phosphatase 1, regulatory subunit 12A
  ENSP ID: ENSP00000450059
  MOD_RES (1)..(1): Any amino acid
XEDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQSSPVQDTTETRKIC

SEQ ID NO: 68554 - protein, 299 aa, Homo sapiens
  Payload ID: 13643
  Gene Symbol: PPP1R12A
  Gene Name: protein phosphatase 1, regulatory subunit 12A
  ENSP ID: ENSP00000450061
ANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKRSYLTPVRDEESESQRKARSRQARQSRRSTQGVTLTDLQEAEKTIGRSRSTRT

SEQ ID NO: 68555 - protein, 100 aa, Homo sapiens
  Payload ID: 13643
  Gene Symbol: PPP1R12A
  Gene Name: protein phosphatase 1, regulatory subunit 12A
  ENSP ID: ENSP00000489242
RYDSLLGRSGSYSYLEERKPYSSRLEKDDSTDFKKLYEQILAENEKLKAQLHDTNMELTDLKLQLEKATQRQERFADRSLLEMEKRVTGKRTKSSRKKNI

SEQ ID NO: 68556 - protein, 386 aa, Homo sapiens
  Payload ID: 13644
  Gene Symbol: PPP1R12B
  Gene Name: protein phosphatase 1, regulatory subunit 12B
  Uniprot ID: O60237
  ENSP ID: ENSP00000349206
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEAVLFWPF

SEQ ID NO: 68557 - protein, 1043 aa, Homo sapiens
  Payload ID: 13644
  Gene Symbol: PPP1R12B
  Gene Name: protein phosphatase 1, regulatory subunit 12B
  ENSP ID: ENSP00000375821
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKERENKSYISSLAPRKLNSTSDIEEKENRESAVNLVRSGSYTRQLWRDEAKGNEIPQTIAPSTYVSTYLKSASFGRSSDPTSPYISANRNSSPATSPITIGSSTSRGSQWQPASSCPAPISANTTASVHHGRTPHKSQADTTAEKTADNVSSSTPLCVITNRPLPSTANGVTATPVLSITGTDSSVEAREKRRSYLTPVRDEEAESLRKARSRQARQTRRSTQGVTLTDLQEAERTFSRSRAERQAQEQPREKPTDTEGLEGSPEKHEPSAVPATEAGEGQQPWGRSLDEEPICHRLRCPAQPDKPTTPASPSTSRPSLYTSSHLLWTNRFSVPDSESSETTTNTTTAKEMDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 68558 - protein, 515 aa, Homo sapiens
  Payload ID: 13644
  Gene Symbol: PPP1R12B
  Gene Name: protein phosphatase 1, regulatory subunit 12B
  Uniprot ID: O60237
  ENSP ID: ENSP00000417159
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKVQFGRVWGNSKAVFFFHENSILGTNENIF

SEQ ID NO: 68559 - protein, 142 aa, Homo sapiens
  Payload ID: 13644
  Gene Symbol: PPP1R12B
  Gene Name: protein phosphatase 1, regulatory subunit 12B
  ENSP ID: ENSP00000417814
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAES

SEQ ID NO: 68560 - protein, 212 aa, Homo sapiens
  Payload ID: 13644
  Gene Symbol: PPP1R12B
  Gene Name: protein phosphatase 1, regulatory subunit 12B
  ENSP ID: ENSP00000417975
  MOD_RES (1)..(1): Any amino acid
XNRANVNQQDNEGWTPLHAAASCGYLNIAELLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSA

SEQ ID NO: 68561 - protein, 982 aa, Homo sapiens
  Payload ID: 13644
  Gene Symbol: PPP1R12B
  Gene Name: protein phosphatase 1, regulatory subunit 12B
  Uniprot ID: O60237
  ENSP ID: ENSP00000476755
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKERENKSYISSLAPRKLNSTSDIEEKENRESAVNLVRSGSYTRQLWRDEAKGNEIPQTIAPSTYVSTYLKRTPHKSQADTTAEKTADNVSSSTPLCVITNRPLPSTANGVTATPVLSITGTDSSVEAREKRRSYLTPVRDEEAESLRKARSRQARQTRRSTQGVTLTDLQEAERTFSRSRAERQAQEQPREKPTDTEGLEGSPEKHEPSAVPATEAGEGQQPWGRSLDEEPICHRLRCPAQPDKPTTPASPSTSRPSLYTSSHLLWTNRFSVPDSESSETTTNTTTAKEMDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 68562 - protein, 208 aa, Homo sapiens
  Payload ID: 13644
  Gene Symbol: PPP1R12B
  Gene Name: protein phosphatase 1, regulatory subunit 12B
  Uniprot ID: O60237
  ENSP ID: ENSP00000480852
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 68563 - protein, 224 aa, Homo sapiens
  Payload ID: 13644
  Gene Symbol: PPP1R12B
  Gene Name: protein phosphatase 1, regulatory subunit 12B
  Uniprot ID: O60237
  ENSP ID: ENSP00000484005
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKNLHQLKQIQTLKQMNEQLQAENRALTRVVARLSESIESSDTQEL

SEQ ID NO: 68564 - protein, 186 aa, Homo sapiens
  Payload ID: 13644
  Gene Symbol: PPP1R12B
  Gene Name: protein phosphatase 1, regulatory subunit 12B
  ENSP ID: ENSP00000488930
MSSLYTRSKEFTRNRKSQSDSPPASPSPTAKTLRHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 68565 - protein, 20 aa, Homo sapiens
  Payload ID: 13644
  Gene Symbol: PPP1R12B
  Gene Name: protein phosphatase 1, regulatory subunit 12B
  ENSP ID: ENSP00000489025
PQTIAPSTYVSTYLKRSIKM

SEQ ID NO: 68566 - protein, 8 aa, Homo sapiens
  Payload ID: 13644
  Gene Symbol: PPP1R12B
  Gene Name: protein phosphatase 1, regulatory subunit 12B
  ENSP ID: ENSP00000489098
  MOD_RES (1)..(1): Any amino acid
XWQVTCSN

SEQ ID NO: 68567 - protein, 782 aa, Homo sapiens
  Payload ID: 13645
  Gene Symbol: PPP1R12C
  Gene Name: protein phosphatase 1, regulatory subunit 12C
  Uniprot ID: Q9BZL4
  ENSP ID: ENSP00000263433
MSGEDGPAAGPGAAAAAARERRREQLRQWGARAGAEPGPGERRARTVRFERAAEFLAACAGGDLDEARLMLRAADPGPGAELDPAAPPPARAVLDSTNADGISALHQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 68568 - protein, 707 aa, Homo sapiens
  Payload ID: 13645
  Gene Symbol: PPP1R12C
  Gene Name: protein phosphatase 1, regulatory subunit 12C
  Uniprot ID: Q9BZL4
  ENSP ID: ENSP00000387833
MRNGGPCQPLAAGPRAEGASVNWSVTAWGPGTQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQREAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 68569 - protein, 737 aa, Homo sapiens
  Payload ID: 13645
  Gene Symbol: PPP1R12C
  Gene Name: protein phosphatase 1, regulatory subunit 12C
  ENSP ID: ENSP00000465957
  MOD_RES (1)..(1): Any amino acid
XRTVRFERAAEFLAACAGGDLDEARLMLRAADPGPGAELDPAAPPPARAVLDSTNADGISALHQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQREAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 68570 - protein, 234 aa, Homo sapiens
  Payload ID: 13645
  Gene Symbol: PPP1R12C
  Gene Name: protein phosphatase 1, regulatory subunit 12C
  ENSP ID: ENSP00000468148
  MOD_RES (1)..(1): Any amino acid
XEVTKPPPCLENSSPPSRIPEPESPAKPNVPTASTAPPADSRDRRRSYQMPVRDEESESQRKARSRLMRQSRRSTQGVTLTDLKEAEKAAGKAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 68571 - protein, 828 aa, Homo sapiens
  Payload ID: 13646
  Gene Symbol: PPP1R13L
  Gene Name: protein phosphatase 1, regulatory subunit 13 like
  Uniprot ID: Q8WUF5
  ENSP ID: ENSP00000354218
MDSEAFQSARDFLDMNFQSLAMKHMDLKQMELDTAAAKVDELTKQLESLWSDSPAPPGPQAGPPSRPPRYSSSSIPEPFGSRGSPRKAATDGADTPFGRSESAPTLHPYSPLSPKGRPSSPRTPLYLQPDAYGSLDRATSPRPRAFDGAGSSLGRAPSPRPGPGPLRQQGPPTPFDFLGRAGSPRGSPLAEGPQAFFPERGPSPRPPATAYDAPASAFGSSLLGSGGSAFAPPLRAQDDLTLRRRPPKAWNESDLDVAYEKKPSQTASYERLDVFARPASPSLQLLPWRESSLDGLGGTGKDNLTSATLPRNYKVSPLASDRRSDAGSYRRSLGSAGPSGTLPRSWQPVSRIPMPPSSPQPRGAPRQRPIPLSMIFKLQNAFWEHGASRAMLPGSPLFTRAPPPKLQPQPQPQPQPQSQPQPQLPPQPQTQPQTPTPAPQHPQQTWPPVNEGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 68572 - protein, 828 aa, Homo sapiens; identical to SEQ ID NO: 68571
  Payload ID: 13646
  Gene Symbol: PPP1R13L
  Gene Name: protein phosphatase 1, regulatory subunit 13 like
  Uniprot ID: Q8WUF5
  ENSP ID: ENSP00000403902

SEQ ID NO: 68573 - protein, 90 aa, Homo sapiens
  Payload ID: 13646
  Gene Symbol: PPP1R13L
  Gene Name: protein phosphatase 1, regulatory subunit 13 like
  ENSP ID: ENSP00000466555
ETDWWWAALHGQEGYVPRNYFGIPSKVPPMPTTIITSPSKPATCPAGPGMGHHTTGYSWESLLTPSLPAVLGSGWETLVSTRIPAPPLPN

SEQ ID NO: 68574 - protein, 128 aa, Homo sapiens
  Payload ID: 13646
  Gene Symbol: PPP1R13L
  Gene Name: protein phosphatase 1, regulatory subunit 13 like
  ENSP ID: ENSP00000466730
MDSEAFQSARDFLDMNFQSLAMKHMDLKQMELDTAAAKVDELTKQLESLWSDSPAPPGPQAGPPSRPPRYSSSSIPEPFGSRGSPRKAATDGADTPFGRSESAPTLHPYSPLSPKGRPSSPRTPLYLQ

SEQ ID NO: 68575 - protein, 29 aa, Homo sapiens
  Payload ID: 13646
  Gene Symbol: PPP1R13L
  Gene Name: protein phosphatase 1, regulatory subunit 13 like
  ENSP ID: ENSP00000466939
  MOD_RES (1)..(1): Any amino acid
XEKCDPYREGYADCATYLAAVPQGEASKE

SEQ ID NO: 68576 - protein, 60 aa, Homo sapiens
  Payload ID: 13646
  Gene Symbol: PPP1R13L
  Gene Name: protein phosphatase 1, regulatory subunit 13 like
  ENSP ID: ENSP00000467471
MDSEAFQSARDFLDMNFQSLAMKHMDLKQMELDTAAAKVDELTKQLESLWSDSPAPPGPQ

SEQ ID NO: 68577 - protein, 348 aa, Homo sapiens
  Payload ID: 13646
  Gene Symbol: PPP1R13L
  Gene Name: protein phosphatase 1, regulatory subunit 13 like
  ENSP ID: ENSP00000478646
MEGPVARPLSPTRLQPALPPEAQSVPELEEVARVLAEIPRPLKRRGSMEQAPAVALPPTHKKQYQQIISRLFHRHGGPGPGGRSQSCPPSLRDLRPGQGPLLLPHQLPFHPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 68578 - protein, 1090 aa, Homo sapiens
  Payload ID: 13647
  Gene Symbol: PPP1R13B
  Gene Name: protein phosphatase 1, regulatory subunit 13B
  Uniprot ID: Q96KQ4
  ENSP ID: ENSP00000202556
MMPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 68579 - protein, 143 aa, Homo sapiens
  Payload ID: 13647
  Gene Symbol: PPP1R13B
  Gene Name: protein phosphatase 1, regulatory subunit 13B
  ENSP ID: ENSP00000450734
MMPMILTVFLSNNEQILTEVPITPETTCRDVVEFCKEPGEGSCHLAEVWRGNGFREPSHKTYCTWPGTVAHSCNLNTLGGRERPIPFDHMMYEHLQKWGPRREEVKFFLRHEDSPTENSEQGGRQTQEQRTQRNVINVPGEKR

SEQ ID NO: 68580 - protein, 122 aa, Homo sapiens
  Payload ID: 13647
  Gene Symbol: PPP1R13B
  Gene Name: protein phosphatase 1, regulatory subunit 13B
  ENSP ID: ENSP00000451396
MLMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGDSYLG

SEQ ID NO: 68581 - protein, 106 aa, Homo sapiens
  Payload ID: 13647
  Gene Symbol: PPP1R13B
  Gene Name: protein phosphatase 1, regulatory subunit 13B
  ENSP ID: ENSP00000451433
  MOD_RES (1)..(1): Any amino acid
XKQLVESGAAIFASTISDIETAADKCEEMEEGYIQCSQFLYGKLQLENGLNGAHFSRQRPQCESYSFQEPLYGNMSSVAAQCVCLPVPTLLGRLGGSASCSSSPKG

SEQ ID NO: 68582 - protein, 635 aa, Homo sapiens
  Payload ID: 13647
  Gene Symbol: PPP1R13B
  Gene Name: protein phosphatase 1, regulatory subunit 13B
  ENSP ID: ENSP00000451739
  MOD_RES (1)..(1): Any amino acid
XVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 68583 - protein, 149 aa, Homo sapiens
  Payload ID: 13647
  Gene Symbol: PPP1R13B
  Gene Name: protein phosphatase 1, regulatory subunit 13B
  ENSP ID: ENSP00000452376
MILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAK

SEQ ID NO: 68584 - protein, 674 aa, Homo sapiens
  Payload ID: 13648
  Gene Symbol: PPP1R15A
  Gene Name: protein phosphatase 1, regulatory subunit 15A
  Uniprot ID: O75807
  ENSP ID: ENSP00000200453
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 68585 - protein, 258 aa, Homo sapiens
  Payload ID: 13648
  Gene Symbol: PPP1R15A
  Gene Name: protein phosphatase 1, regulatory subunit 15A
  ENSP ID: ENSP00000469239
  MOD_RES (1)..(1): Any amino acid
XDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVGAESPDSIFFFFLIELESWAVTQAGVQRHDLGSLPTSAAQVQAILVPQPPEYLGLQAHDTTPS

SEQ ID NO: 68586 - protein, 713 aa, Homo sapiens
  Payload ID: 13649
  Gene Symbol: PPP1R15B
  Gene Name: protein phosphatase 1, regulatory subunit 15B
  Uniprot ID: Q5SWA1
  ENSP ID: ENSP00000356156
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 68587 - protein, 528 aa, Homo sapiens
  Payload ID: 13650
  Gene Symbol: PPP1R16A
  Gene Name: protein phosphatase 1, regulatory subunit 16A
  Uniprot ID: Q96I34
  ENSP ID: ENSP00000292539
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGITQDSIEAARAVPELRMLDDIRSRLQAGADLHAPLDHGATLLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 68588 - protein, 528 aa, Homo sapiens; identical to SEQ ID NO: 68587
  Payload ID: 13650
  Gene Symbol: PPP1R16A
  Gene Name: protein phosphatase 1, regulatory subunit 16A
  Uniprot ID: Q96I34
  ENSP ID: ENSP00000391126

SEQ ID NO: 68589 - protein, 65 aa, Homo sapiens
  Payload ID: 13650
  Gene Symbol: PPP1R16A
  Gene Name: protein phosphatase 1, regulatory subunit 16A
  ENSP ID: ENSP00000480604
MAEHLELLAEMPMVGRMSTQERLKHAQKRRAQQVKMWAQAEKEAQGKKGPGERPRKEAASQGLLK

SEQ ID NO: 68590 - protein, 567 aa, Homo sapiens
  Payload ID: 13651
  Gene Symbol: PPP1R16B
  Gene Name: protein phosphatase 1, regulatory subunit 16B
  Uniprot ID: Q96T49
  ENSP ID: ENSP00000299824
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 68591 - protein, 525 aa, Homo sapiens
  Payload ID: 13651
  Gene Symbol: PPP1R16B
  Gene Name: protein phosphatase 1, regulatory subunit 16B
  Uniprot ID: Q96T49
  ENSP ID: ENSP00000362428
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 68592 - protein, 155 aa, Homo sapiens
  Payload ID: 13652
  Gene Symbol: PPP1R17
  Gene Name: protein phosphatase 1, regulatory subunit 17
  Uniprot ID: O96001
  ENSP ID: ENSP00000340125
MMSTEQMQPLELSEDRLDKLDPRCSHLDDLSDQFIKDCDLKKKPRKGKNVQATLNVESDQKKPRRKDTPALHIPPFIPGVFSEHLIKRYDVQERHPKGKMIPVLHNTDLEQKKPRRKDTPALHMSPFAAGVTLLRDERPKAIVEDDEKDGDKIAI

SEQ ID NO: 68593 - protein, 104 aa, Homo sapiens
  Payload ID: 13652
  Gene Symbol: PPP1R17
  Gene Name: protein phosphatase 1, regulatory subunit 17
  Uniprot ID: O96001
  ENSP ID: ENSP00000386459
MMSTEQMQPLELSEDRLDKLDPRCSHLGVFSEHLIKRYDVQERHPKGKMIPVLHNTDLEQKKPRRKDTPALHMSPFAAGVTLLRDERPKAIVEDDEKDGDKIAI

SEQ ID NO: 68594 - protein, 613 aa, Homo sapiens
  Payload ID: 13653
  Gene Symbol: PPP1R18
  Gene Name: protein phosphatase 1, regulatory subunit 18
  Uniprot ID: Q6NYC8
  ENSP ID: ENSP00000274853
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 68595 - protein, 613 aa, Homo sapiens [sequence omitted]

SEQ ID NO: 68596 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000382150

SEQ ID NO: 68597 - protein, 613 aa, Homo sapiens [sequence omitted]

SEQ ID NO: 68598 - protein, 613 aa, Homo sapiens
  Payload ID: 13653
  Gene Symbol: PPP1R18
  Gene Name: protein phosphatase 1, regulatory subunit 18
  ENSP ID: ENSP00000387526
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSRKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 68599 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000388790

SEQ ID NO: 68600 - protein, 613 aa, Homo sapiens; identical to SEQ ID NO: 68598
  Payload ID: 13653
  Gene Symbol: PPP1R18
  Gene Name: protein phosphatase 1, regulatory subunit 18
  ENSP ID: ENSP00000399786

SEQ ID NO: 68601 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000400129

SEQ ID NO: 68602 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000400990

SEQ ID NO: 68603 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000404066

SEQ ID NO: 68604 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000405234

SEQ ID NO: 68605 - protein, 76 aa, Homo sapiens
  Payload ID: 13653
  Gene Symbol: PPP1R18
  Gene Name: protein phosphatase 1, regulatory subunit 18
  ENSP ID: ENSP00000411275
LKISFSETALETTYQYPSESSVLEELGPEPEVPSAPNPPAAQPDDEEDEEELLLLQPELQGGLRTKALIVDESCRR

SEQ ID NO: 68606 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000412456

SEQ ID NO: 68607 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000413596

SEQ ID NO: 68608 - protein, 76 aa, Homo sapiens; identical to SEQ ID NO: 68605
  Payload ID: 13653
  Gene Symbol: PPP1R18
  Gene Name: protein phosphatase 1, regulatory subunit 18
  ENSP ID: ENSP00000416491

SEQ ID NO: 68609 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000416648

SEQ ID NO: 68610 - protein, 613 aa, Homo sapiens; identical to SEQ ID NO: 68594
  Payload ID: 13653
  Gene Symbol: PPP1R18
  Gene Name: protein phosphatase 1, regulatory subunit 18
  Uniprot ID: Q6NYC8
  ENSP ID: ENSP00000480270

SEQ ID NO: 68611 - protein, 165 aa, Homo sapiens
  Payload ID: 13653
  Gene Symbol: PPP1R18
  Gene Name: protein phosphatase 1, regulatory subunit 18
  Uniprot ID: Q6NYC8
  ENSP ID: ENSP00000482578
MSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 68612 - protein, 769 aa, Homo sapiens
  Payload ID: 13654
  Gene Symbol: PPP1R21
  Gene Name: protein phosphatase 1, regulatory subunit 21
  Uniprot ID: Q6ZMI0
  ENSP ID: ENSP00000281394
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 68613 - protein, 780 aa, Homo sapiens
  Payload ID: 13654
  Gene Symbol: PPP1R21
  Gene Name: protein phosphatase 1, regulatory subunit 21
  Uniprot ID: Q6ZMI0
  ENSP ID: ENSP00000294952
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKPLLESVPYEEALANRRILLSSTESREGLAQQVQQSLEKISKLEQEKEHWMLEAQLAKIKLEKENQRIADKLKNTGSAQLVGLAQENAAVSNTAGQDEATAKAVLEPIQSTSLIGTLTRTSDSEVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 68614 - protein, 116 aa, Homo sapiens
  Payload ID: 13654
  Gene Symbol: PPP1R21
  Gene Name: protein phosphatase 1, regulatory subunit 21
  ENSP ID: ENSP00000403001
  MOD_RES (1)..(1): Any amino acid
XHLTSYICFLRKILPYQLKSLEEECESSLCTSALRARNLELSQDMKKMTAVFEKLQTYIALLALPILQRASRSTELLTLTWQKQNSVIFGYRARWTPSDKLQFCVNKCWCCSAWIS

SEQ ID NO: 68615 - protein, 53 aa, Homo sapiens
  Payload ID: 13654
  Gene Symbol: PPP1R21
  Gene Name: protein phosphatase 1, regulatory subunit 21
  ENSP ID: ENSP00000406283
MKDQSLRKLQQEMDSLTFRNLQLAKRVELLQDELALSEPRGKKNKDCLRMVNT

SEQ ID NO: 68616 - protein, 40 aa, Homo sapiens
  Payload ID: 13654
  Gene Symbol: PPP1R21
  Gene Name: protein phosphatase 1, regulatory subunit 21
  ENSP ID: ENSP00000410955
MKDQSLRKLQQEMDSLTFRNLQLAKRVELLQDELALSEPR

SEQ ID NO: 68617 - protein, 54 aa, Homo sapiens
  Payload ID: 13654
  Gene Symbol: PPP1R21
  Gene Name: protein phosphatase 1, regulatory subunit 21
  ENSP ID: ENSP00000414130
MASAELQGKYQKLAQEYSKLRAQNQVLKKGVVDEQANSAALKLNCEDQSVFTLI

SEQ ID NO: 68618 - protein, 738 aa, Homo sapiens
  Payload ID: 13654
  Gene Symbol: PPP1R21
  Gene Name: protein phosphatase 1, regulatory subunit 21
  Uniprot ID: Q6ZMI0
  ENSP ID: ENSP00000415696
MASAELQGKYQKLAQEYSKLRAQNQVLKKGVVDEQANSAALKEQLKMKDQSLRKLQQEMDSLTFRNLQLAKRVELLQDELALSEPRGKKNKKSGESSSQLSQEQKSVFDEDLQKKIEENERLHIQFFEADEQHKHVEAELRSRLATLETEAAQHQAVVDGLTRKYMETIEKLQNDKAKLEVKSQTLEKEAKECRLRTEECQLQLKTLHEDLSGRLEESLSIINEKVPFNDTKYSQYNALNVPLHNRRHQLKMRDIAGQALAFVQDLVTALLNFHTYTEQRIQIFPVDSAIDTISPLNQKFSQYLHENASYVRPLEEGMLHLFESITEDTVTVLETTVKLKTFSEHLTSYICFLRKILPYQLKSLEEECESSLCTSALRARNLELSQDMKKMTAVFEKLQTYIALLALPSTEPDGLLRTNYSSVLTNVGAALHGFHDVMKDISKHYSQKAAIEHELPTATQKLITTNDCILSSVVALTNGAGKIASFFSNNLDYFIASLSYGPKAASGFISPLSAECMLQYKKKAAAYMKSLRKVQQSLEKISKLEQEKEHWMLEAQLAKIKLEKENQRIADKLKNTGSAQLVGLAQENAAVSNTAGQDEATAKAVLEPIQSTSLVPDVESREDLIKNHYMARIVELTSQLQLADSKSVHFYAECRALSKRLALAEKSKEALTEEMKLASQNISRLQDELTTTKRSYEDQLSMMSDHLCSMNETLSKQREEIDTLKMSSKGNSKKNKSR

SEQ ID NO: 68619 - protein, 1209 aa, Homo sapiens
  Payload ID: 13655
  Gene Symbol: PPP1R26
  Gene Name: protein phosphatase 1, regulatory subunit 26
  Uniprot ID: Q5T8A7
  ENSP ID: ENSP00000349274
MFLMNASPVVALQSKWEAFGPPGSCRFPRCFSEADEGVESASVSARVQMLISTLQRDGAARGTSDERAAQRGHRAEGCHDARPAAKPTVHKEPPALAVCGLVADFDPMGEEETTDFGPLVLDSDSDDSVDRDIEEAIQEYLKAKSGAAQPGAGGAQPGAAQPSRAAGGGSRCKPEPAHGSAPTALCPPKLVPGSGGGPGSQVGSSKDQGSASPVSVSSDDSFEQSIRAEIEQFLNEKRQHETQKCDGSVEKKPDTNENSAKSLLKSHQEPPTKVVHRQGLLGVQKEFAFRKPPRLAKMNVQPRSLRSKVTTTQENEGSTKPATPCRPSEAAQNKGGIKRSASAARRGKRVMSAAQASEASDSSSDDGIEEAIQLYQLQKTRKEADGDLPQRVQLREERAPDPPAHSTSSATKSALPETHRKTPSKKKLVATKTMDPGPGGLDTDHAPKLLKETKAPPPASPASRSEFVERSSCRADTSAELMCAEAILDISKTILPAPVEGSDGSLSASPLFYSPNVPSRSDGDSSSVDSDDSIEQEIRTFLALKAQSGSLLARGESCPQAAQGPLLPPGLNSQTGGHKTPLSKTPDPLLGCKRKRRGGGHVRPSTPKKMQEVVKDGSQDADHSQGRAEPGHERRDLPIQGKASEALGGEGTARGPGDTRMSQGQGKTDEARRLDEKESSEDKSSSLDSDEDLDTAIKDLLRSKRKLKKRCREPRAACRKKVRFSTAQTHFLEQLGGLRRDWKDRGPPVLKSCLSKSKRDSGEGPGKKPPSVFGSTAERMRQEGAASQDAALAFRVRRPASASASEGNPFPRESQGPAPSPGSLSDDSSSVDSNDSIELEIRKFLAEKAKESVSSSEVQAEGPTALGTGGPARPEVLCRKEPAPPPGVCTRSQRARGVPHLAEGLRGTESAGAQGTAGLFSQGGKGLPAAPARGDPVPPRSTSGGVSAKGLSVSRRNVYVHKDQSPRGAEPAAKSAFGQLPSCATAGTEAGGARGTFHMGCGSPSFLTPSPGAERDAGAQADRTPPWSDFAHQSRLPSPWVLRSEGRDAVWRGGVGSERDKGSEGPARGLPSLPLAGFSPLLSTQLFHFGKGVSWGGRQAGLFSPHLGLPLQGPSFSAFREAQAGPSPVFGSPHLLAKKDGGPWPTRKAQAGLSLHDRRSSGSEESILDLRYRRRVNRDDQEQDALGSDASDFSDTSTEDSGGSSVVKV

SEQ ID NO: 68620 - protein, 1209 aa, Homo sapiens; identical to SEQ ID NO: 68619
  Payload ID: 13655
  Gene Symbol: PPP1R26
  Gene Name: protein phosphatase 1, regulatory subunit 26
  Uniprot ID: Q5T8A7
  ENSP ID: ENSP00000385826

SEQ ID NO: 68621 - protein, 1209 aa, Homo sapiens; identical to SEQ ID NO: 68619
  Payload ID: 13655
  Gene Symbol: PPP1R26
  Gene Name: protein phosphatase 1, regulatory subunit 26
  Uniprot ID: Q5T8A7
  ENSP ID: ENSP00000473820

SEQ ID NO: 68622 - protein, 1209 aa, Homo sapiens; identical to SEQ ID NO: 68619
  Payload ID: 13655
  Gene Symbol: PPP1R26
  Gene Name: protein phosphatase 1, regulatory subunit 26
  Uniprot ID: Q5T8A7
  ENSP ID: ENSP00000474794

SEQ ID NO: 68623 - protein, 1209 aa, Homo sapiens; identical to SEQ ID NO: 68619
  Payload ID: 13655
  Gene Symbol: PPP1R26
  Gene Name: protein phosphatase 1, regulatory subunit 26
  Uniprot ID: Q5T8A7
  ENSP ID: ENSP00000474807

SEQ ID NO: 68624 - protein, 154 aa, Homo sapiens
  Payload ID: 13656
  Gene Symbol: PPP1R27
  Gene Name: protein phosphatase 1, regulatory subunit 27
  Uniprot ID: Q86WC6
  ENSP ID: ENSP00000331065
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYPDIARYLISLGADRDATNDDGDLPSDLIDPDYKELVELFKGTTMD

SEQ ID NO: 68625 - protein, 114 aa, Homo sapiens
  Payload ID: 13656
  Gene Symbol: PPP1R27
  Gene Name: protein phosphatase 1, regulatory subunit 27
  ENSP ID: ENSP00000459421
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYPDIAR

SEQ ID NO: 68626 - protein, 425 aa, Homo sapiens
  Payload ID: 13657
  Gene Symbol: PPP1R32
  Gene Name: protein phosphatase 1, regulatory subunit 32
  Uniprot ID: Q7Z5V6
  ENSP ID: ENSP00000344140
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQALPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 68627 - protein, 405 aa, Homo sapiens
  Payload ID: 13657
  Gene Symbol: PPP1R32
  Gene Name: protein phosphatase 1, regulatory subunit 32
  Uniprot ID: Q7Z5V6
  ENSP ID: ENSP00000391560
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQALPGDPGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 68628 - protein, 137 aa, Homo sapiens
  Payload ID: 13657
  Gene Symbol: PPP1R32
  Gene Name: protein phosphatase 1, regulatory subunit 32
  ENSP ID: ENSP00000437511
GQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGTLTSADPFYQNTPHSSRCVAHS

SEQ ID NO: 68629 - protein, 55 aa, Homo sapiens
  Payload ID: 13657
  Gene Symbol: PPP1R32
  Gene Name: protein phosphatase 1, regulatory subunit 32
  ENSP ID: ENSP00000439468
MPGGYALSQPVSCMEATPNPMESLRHLHPHVGRTLTSADPFYQNTPHSSRCVAHS

SEQ ID NO: 68630 - protein, 176 aa, Homo sapiens
  Payload ID: 13657
  Gene Symbol: PPP1R32
  Gene Name: protein phosphatase 1, regulatory subunit 32
  ENSP ID: ENSP00000441053
PSQALPGDPALLPGQSVTKSDFLPKTHLHVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 68631 - protein, 102 aa, Homo sapiens
  Payload ID: 13657
  Gene Symbol: PPP1R32
  Gene Name: protein phosphatase 1, regulatory subunit 32
  ENSP ID: ENSP00000444387
MEKGSRGCRGGQSPASSQGPLLSSRYFENIPKGLDQEGWTRGGIQPQMPGGYALSQPVSCMEATPNPMESLRHLHPHVGRTLTSADPFYQNTPHSSRCVAHS

SEQ ID NO: 68632 - protein, 253 aa, Homo sapiens
  Payload ID: 13658
  Gene Symbol: PPP1R35
  Gene Name: protein phosphatase 1, regulatory subunit 35
  Uniprot ID: Q8TAP8
  ENSP ID: ENSP00000292330
MMMGCGESELKSADGEEAAAVPGPPPEPQVPQLRAPVPEPGLDLSLSPRPDSPQPRHGSPGRRKGRAERRGAARQRRQVRFRLTPPSPVRSEPQPAVPQELEMPVLKSSLALGLELRAAAGSHFDAAKAVEEQLRKSFQIRCGLEESVSEGLNVPRSKRLFRDLVSLQVPEEQVLNAALREKLALLPPQARAPHPKEPPGPGPDMTILCDPETLFYESPHLTLDGLPPLRLQLRPRPSEDTFLMHRTLRRWEA

SEQ ID NO: 68633 - protein, 422 aa, Homo sapiens
  Payload ID: 13659
  Gene Symbol: PPP1R36
  Gene Name: protein phosphatase 1, regulatory subunit 36
  Uniprot ID: Q96LQ0
  ENSP ID: ENSP00000298705
MYRVPEFYARRKRLGGQTPYLMDQLGLRLGMWYWKDETRTLEFRRFAAEDSVQWLLKHHPHFTPAAEVKEKGKKGKAVHFAETDGPASDRLTDKRLAAKDDKSAKAVEKRGQQGTITLDDVKFVTLLLLQDTEMQRICSFTTFMRNKNLDNFLMALLYYLSHYLEKNSLEKKPKSYMVGLVEKKEMELVLSELEAAQRYLAQKYCILVLGLAVPDKHHMCCGKEKISDTQKDWKFFESFYTFCTYVAWIVFRRQHLTEIEEEVGRLFRTNMFNIPRRRREDEESGGEKKRMTFVQFRRMMAKRPAIKKAINMRSPVMSTLLPSLREKAQNVFEKKYHQVDVRFPAEMQKHVGTLDSVPMPVVGILGEPRCLFNPHTLHPLDPEENTKSFGRYPSLMENNNMRIQDTLDLVMKTLSSHTSCPK

SEQ ID NO: 68634 - protein, 45 aa, Homo sapiens
  Payload ID: 13659
  Gene Symbol: PPP1R36
  Gene Name: protein phosphatase 1, regulatory subunit 36
  ENSP ID: ENSP00000435229
MYRVPEFYARRKRLGGQTPYLMDQLGLRLGMWYWKDETRTLEFRR

SEQ ID NO: 68635 - protein, 74 aa, Homo sapiens
  Payload ID: 13659
  Gene Symbol: PPP1R36
  Gene Name: protein phosphatase 1, regulatory subunit 36
  ENSP ID: ENSP00000451900
MYRVPEFYARRKRLGGQTPYLMDQLGLRLGMWYWKDETRTLEFRRFAAEDSVQWLLKHHPHAPIPKLAENQQSA

SEQ ID NO: 68636 - protein, 44 aa, Homo sapiens
  Payload ID: 13659
  Gene Symbol: PPP1R36
  Gene Name: protein phosphatase 1, regulatory subunit 36
  ENSP ID: ENSP00000452491
MQRICSFTTFMRNKNLDNFLMALLYYLSHYLEKNSLEKKPKSYM

SEQ ID NO: 68637 - protein, 691 aa, Homo sapiens
  Payload ID: 13660
  Gene Symbol: PPP1R37
  Gene Name: protein phosphatase 1, regulatory subunit 37
  Uniprot ID: O75864
  ENSP ID: ENSP00000221462
MEIAPQEAPPVPGADGDIEEAPAEAGSPSPASPPADGRLKAAAKRVTFPSDEDIVSGAVEPKDPWRHAQNVTVDEVIGAYKQACQKLNCRQIPKLLRQLQEFTDLGHRLDCLDLKGEKLDYKTCEALEEVFKRLQFKVVDLEQTNLDEDGASALFDMIEYYESATHLNISFNKHIGTRGWQAAAHMMRKTSCLQYLDARNTPLLDHSAPFVARALRIRSSLAVLHLENASLSGRPLMLLATALKMNMNLRELYLADNKLNGLQDSAQLGNLLKFNCSLQILDLRNNHVLDSGLAYICEGLKEQRKGLVTLVLWNNQLTHTGMAFLGMTLPHTQSLETLNLGHNPIGNEGVRHLKNGLISNRSVLRLGLASTKLTCEGAVAVAEFIAESPRLLRLDLRENEIKTGGLMALSLALKVNHSLLRLDLDREPKKEAVKSFIETQKALLAEIQNGCKRNLVLAREREEKEQPPQLSASMPETTATEPQPDDEPAAGVQNGAPSPAPSPDSDSDSDSDGEEEEEEEGERDETPCPALVPPTDSLGPGDRSPPGSPSTPTEQRISVSSPGRGHKVFVVTRVESPPERAEPPASPTPPSPPPPPSPPASPSLPPAGAIDTRDTGSSEPQPPPEPPRSGPPLPNGLKPEFALALPPEPPPGPEVKGGSCGLEHELSCSKNEKELEELLLEASQESGQETL

SEQ ID NO: 68638 - protein, 186 aa, Homo sapiens
  Payload ID: 13660
  Gene Symbol: PPP1R37
  Gene Name: protein phosphatase 1, regulatory subunit 37
  ENSP ID: ENSP00000445252
MEIAPQEAPPVPGADGDIEEAPAEAGSPSPASPPADGRLKAAAKRVTFPSDEDIVSGAVEPKDPWRHGEKLDYKTCEALEEVFKRLQFKVVDLEQTNLDEDGASALFDMIEYYESATHLNISFNKHIGTRGWQAAAHMMRKTSCLQYLDARNTPLLDHSAPFVARALRIRSSLAVLHLENASLSGR

SEQ ID NO: 68639 - protein, 1122 aa, Homo sapiens
  Payload ID: 13661
  Gene Symbol: PPP1R3A
  Gene Name: protein phosphatase 1, regulatory subunit 3A
  Uniprot ID: Q16821
  ENSP ID: ENSP00000284601
MEPSEVPSQISKDNFLEVPNLSDSLCEDEEVTFQPGFSPQPSRRGSDSSEDIYLDTPSSGTRRVSFADSFGFNLVSVKEFDCWELPSASTTFDLGTDIFHTEEYVLAPLFDLPSSKEDLMQQLQIQKAILESTESLLGSTSIKGIIRVLNVSFEKLVYVRMSLDDWQTHYDILAEYVPNSCDGETDQFSFKIVLVPPYQKDGSKVEFCIRYETSVGTFWSNNNGTNYTFICQKKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTVQIPCPSSDQLMAGNLNKKHEGGAKNIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDLRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 68640 - protein, 74 aa, Homo sapiens
  Payload ID: 13661
  Gene Symbol: PPP1R3A
  Gene Name: protein phosphatase 1, regulatory subunit 3A
  Uniprot ID: Q16821
  ENSP ID: ENSP00000284602
MEPSEVPSQISKDNFLEVPNLSDSLCEDEEVTFQPGFSPQPSRRGSDSSEDIYLDTPSSERTRAGACKTMERSS

SEQ ID NO: 68641 - protein, 191 aa, Homo sapiens
  Payload ID: 13661
  Gene Symbol: PPP1R3A
  Gene Name: protein phosphatase 1, regulatory subunit 3A
  ENSP ID: ENSP00000401278
MINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTVQIPCPSSDQLMAGNLNKKHEGGAKNIEVKDLGCLRRDFHSDTSACLKESTEEGSSKEDYYG

SEQ ID NO: 68642 - protein, 285 aa, Homo sapiens
  Payload ID: 13662
  Gene Symbol: PPP1R3B
  Gene Name: protein phosphatase 1, regulatory subunit 3B
  Uniprot ID: Q86XI6
  ENSP ID: ENSP00000308318
MMAVDIEYRYNCMAPSLRQERFAFKISPKPSKPLRPCIQLSSKNEASGMVAPAVQEKKVKKRVSFADNQGLALTMVKVFSEFDDPLDMPFNITELLDNIVSLTTAESESFVLDFSQPSADYLDFRNRLQADHVCLENCVLKDKAIAGTVKVQNLAFEKTVKIRMTFDTWKSYTDFPCQYVKDTYAGSDRDTFSFDISLPEKIQSYERMEFAVYYECNGQTYWDSNRGKNYRIIRAELKSTQGMTKPHSGPDLGISFDQFGSPRCSYGLFPEWPSYLGYEKLGPYY

SEQ ID NO: 68643 - protein, 285 aa, Homo sapiens; identical to SEQ ID NO: 68642
  Payload ID: 13662
  Gene Symbol: PPP1R3B
  Gene Name: protein phosphatase 1, regulatory subunit 3B
  Uniprot ID: Q86XI6
  ENSP ID: ENSP00000428642

SEQ ID NO: 68644 - protein, 317 aa, Homo sapiens
  Payload ID: 13663
  Gene Symbol: PPP1R3C
  Gene Name: protein phosphatase 1, regulatory subunit 3C
  Uniprot ID: Q9UQK1
  ENSP ID: ENSP00000238994
MSCTRMIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALKHHEEKNLILDFPQPSTDYLSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 68645 - protein, 299 aa, Homo sapiens
  Payload ID: 13664
  Gene Symbol: PPP1R3D
  Gene Name: protein phosphatase 1, regulatory subunit 3D
  Uniprot ID: O95685
  ENSP ID: ENSP00000360035
MSRGPSSAVLPSALGSRKLGPRSLSCLSDLDGGVALEPRACRPPGSPGRAPPPTPAPSGCDPRLRPIILRRARSLPSSPERRQKAAGAPGAACRPGCSQKLRVRFADALGLELAQVKVFNAGDDPSVPLHVLSRLAINSDLCCSSQDLEFTLHCLVPDFPPPVEAADFGERLQRQLVCLERVTCSDLGISGTVRVCNVAFEKQVAVRYTFSGWRSTHEAVARWRGPAGPEGTEDVFTFGFPVPPFLLELGSRVHFAVRYQVAGAEYWDNNDHRDYSLTCRNHALHMPRGECEESWIHFI

SEQ ID NO: 68646 - protein, 279 aa, Homo sapiens
  Payload ID: 13665
  Gene Symbol: PPP1R3E
  Gene Name: protein phosphatase 1, regulatory subunit 3E
  Uniprot ID: Q9H7J1
  ENSP ID: ENSP00000408288
MSRERPPGTDIPRNLSFIAALTERAYYRSQRPSLEEEPEEEPGEGGTRFGARSRAHAPSRGRRARSAPAGGGGARAPRSRSPDTRKRVRFADALGLELAVVRRFRPGELPRVPRHVQIQLQRDALRHFAPCQPRARGLQEARAALEPASEPGFAARLLTQRICLERAEAGPLGVAGSARVVDLAYEKRVSVRWSADGWRSQREAPAAYAGPAPPPPRADRFAFRLPAPPIGGALLFALRYRVTGHEFWDNNGGRDYALRGPEHPGSGGAPEPQGWIHFI

SEQ ID NO: 68647 - protein, 49 aa, Homo sapiens
  Payload ID: 13665
  Gene Symbol: PPP1R3E
  Gene Name: protein phosphatase 1, regulatory subunit 3E
  ENSP ID: ENSP00000453175
  MOD_RES (1)..(1): Any amino acid
XGALLFALRYRVTGHEFWDNNGGRDYALRGPEHPGSGGAPEPQGWIHFI

SEQ ID NO: 68648 - protein, 18 aa, Homo sapiens
  Payload ID: 13665
  Gene Symbol: PPP1R3E
  Gene Name: protein phosphatase 1, regulatory subunit 3E
  ENSP ID: ENSP00000453437
EHPGSGGAPEPQGWIHFI

SEQ ID NO: 68649 - protein, 29 aa, Homo sapiens
  Payload ID: 13665
  Gene Symbol: PPP1R3E
  Gene Name: protein phosphatase 1, regulatory subunit 3E
  ENSP ID: ENSP00000453543
NGGRDYALRGPEHPGSGGAPEPQGWIHFI

SEQ ID NO: 68650 - protein, 13 aa, Homo sapiens
  Payload ID: 13665
  Gene Symbol: PPP1R3E
  Gene Name: protein phosphatase 1, regulatory subunit 3E
  ENSP ID: ENSP00000453726
  MOD_RES (1)..(1): Any amino acid
XGAPEPQGWIHFI

SEQ ID NO: 68651 - protein, 34 aa, Homo sapiens
  Payload ID: 13665
  Gene Symbol: PPP1R3E
  Gene Name: protein phosphatase 1, regulatory subunit 3E
  ENSP ID: ENSP00000454106
  MOD_RES (1)..(1): Any amino acid
XFWDNNGGRDYALRGPEHPGSGGAPEPQGWIHFI

SEQ ID NO: 68652 - protein, 799 aa, Homo sapiens
  Payload ID: 13666
  Gene Symbol: PPP1R3F
  Gene Name: protein phosphatase 1, regulatory subunit 3F
  Uniprot ID: Q6ZSY5
  ENSP ID: ENSP00000055335
MARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 68653 - protein, 453 aa, Homo sapiens
  Payload ID: 13666
  Gene Symbol: PPP1R3F
  Gene Name: protein phosphatase 1, regulatory subunit 3F
  Uniprot ID: Q6ZSY5
  ENSP ID: ENSP00000365359
MDDNTFAMEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 68654 - protein, 453 aa, Homo sapiens; identical to SEQ ID NO: 68653
  Payload ID: 13666
  Gene Symbol: PPP1R3F
  Gene Name: protein phosphatase 1, regulatory subunit 3F
  Uniprot ID: Q6ZSY5
  ENSP ID: ENSP00000417535

SEQ ID NO: 68655 - protein, 161 aa, Homo sapiens
  Payload ID: 13666
  Gene Symbol: PPP1R3F
  Gene Name: protein phosphatase 1, regulatory subunit 3F
  ENSP ID: ENSP00000418949
  MOD_RES (1)..(1): Any amino acid
XGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVKSNHGVKRRQAEMMQAAPMLEICSLKFSQ

SEQ ID NO: 68656 - protein, 453 aa, Homo sapiens; identical to SEQ ID NO: 68653
  Payload ID: 13666
  Gene Symbol: PPP1R3F
  Gene Name: protein phosphatase 1, regulatory subunit 3F
  Uniprot ID: Q6ZSY5
  ENSP ID: ENSP00000420687

SEQ ID NO: 68657 - protein, 358 aa, Homo sapiens
  Payload ID: 13667
  Gene Symbol: PPP1R3G
  Gene Name: protein phosphatase 1, regulatory subunit 3G
  Uniprot ID: B7ZBB8
  ENSP ID: ENSP00000393832
MEPIGARLSLEAPGPAPFREAPPAEELPAPVVPCVQGGGDGGGASETPSPDAQLGDRPLSPKEEAAPQEQEELLECRRRCRARSFSLPADPILQAAKFLQQQQQQAVALGGEGAEDAQLGPGGCCAKCKKRVQFADTLGLSLASVKHFSEAEEPQVPPAVLSRLRSFPMRAEDLEQLGGLLAAAAVAAPLSAPPSRLRPLFQLPGPSAAAERLQRQRVCLERVQCSTASGAEVKGSGRVLSCPGPRAVTVRYTFTEWRSFLDVPAELQPEPLEPQQPEAPSGASEPGSGDAKKEPGAECFHFSLCLPPGLQPEDEEDADERGVAVHFAVCYRCAQGEYWDNNAGANYTLRYARPADAL

SEQ ID NO: 68658 - protein, 228 aa, Homo sapiens
  Payload ID: 13668
  Gene Symbol: PPP1R42
  Gene Name: protein phosphatase 1, regulatory subunit 42
  Uniprot ID: Q7Z4L9
  ENSP ID: ENSP00000315035
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLGTYLY

SEQ ID NO: 68659 - protein, 309 aa, Homo sapiens
  Payload ID: 13668
  Gene Symbol: PPP1R42
  Gene Name: protein phosphatase 1, regulatory subunit 42
  ENSP ID: ENSP00000429721
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLEFLDGKEIKNIERQFLMNWKASKDAKKISKKRSSKNEDASNSLISNFKTMHHIVPVYYPQVGKPKLAFFSEIQRYPVNANASPESS

SEQ ID NO: 68660 - protein, 360 aa, Homo sapiens
  Payload ID: 13669
  Gene Symbol: PPP1R7
  Gene Name: protein phosphatase 1, regulatory subunit 7
  Uniprot ID: Q15435
  ENSP ID: ENSP00000234038
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 68661 - protein, 317 aa, Homo sapiens
  Payload ID: 13669
  Gene Symbol: PPP1R7
  Gene Name: protein phosphatase 1, regulatory subunit 7
  Uniprot ID: Q15435
  ENSP ID: ENSP00000272983
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 68662 - protein, 221 aa, Homo sapiens
  Payload ID: 13669
  Gene Symbol: PPP1R7
  Gene Name: protein phosphatase 1, regulatory subunit 7
  Uniprot ID: Q15435
  ENSP ID: ENSP00000385012
MEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 68663 - protein, 280 aa, Homo sapiens
  Payload ID: 13669
  Gene Symbol: PPP1R7
  Gene Name: protein phosphatase 1, regulatory subunit 7
  Uniprot ID: Q15435
  ENSP ID: ENSP00000385022
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 68664 - protein, 237 aa, Homo sapiens
  Payload ID: 13669
  Gene Symbol: PPP1R7
  Gene Name: protein phosphatase 1, regulatory subunit 7
  Uniprot ID: Q15435
  ENSP ID: ENSP00000385466
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 68665 - protein, 274 aa, Homo sapiens
  Payload ID: 13669
  Gene Symbol: PPP1R7
  Gene Name: protein phosphatase 1, regulatory subunit 7
  ENSP ID: ENSP00000385498
MAAERGAGQQQSQEMMEVDRRVESEESGDEEGKKHSSGIVADLSEQSLKDGEERGEEDPEEEHELPVDMETINLDRDAEDVDLNHYRIGKIEGFETLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 68666 - protein, 360 aa, Homo sapiens; identical to SEQ ID NO: 68660
  Payload ID: 13669
  Gene Symbol: PPP1R7
  Gene Name: protein phosphatase 1, regulatory subunit 7
  Uniprot ID: Q15435
  ENSP ID: ENSP00000385657

SEQ ID NO: 68667 - protein, 335 aa, Homo sapiens
  Payload ID: 13669
  Gene Symbol: PPP1R7
  Gene Name: protein phosphatase 1, regulatory subunit 7
  ENSP ID: ENSP00000392373
  MOD_RES (1)..(1): Any amino acid
XRVESEESGDEEGKKHSSGIVADLSEQSLKDGEERGEEDPEEEHELPVDMETINLDRDAEDVDLNHYRIGKIEGFETLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 68668 - protein, 282 aa, Homo sapiens
  Payload ID: 13669
  Gene Symbol: PPP1R7
  Gene Name: protein phosphatase 1, regulatory subunit 7
  ENSP ID: ENSP00000396376
MVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTEL

SEQ ID NO: 68669 - protein, 140 aa, Homo sapiens
  Payload ID: 13669
  Gene Symbol: PPP1R7
  Gene Name: protein phosphatase 1, regulatory subunit 7
  ENSP ID: ENSP00000397985
LEGNEVGDRVREKSKNHSRRRKLLSKVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQ

SEQ ID NO: 68670 - protein, 184 aa, Homo sapiens
  Payload ID: 13669
  Gene Symbol: PPP1R7
  Gene Name: protein phosphatase 1, regulatory subunit 7
  ENSP ID: ENSP00000409719
MAAERGAGQQQSQEMMEVDRRVESEESGDEEGKKHSSGIVADLSEQSLKDGEERGEEDPEEEHELPVDMETINLDRDAEISALFQDVDLNHYRIGKIEGFEVLKKVKTLCLRQNLIKCIENLEELQSLRELDLYDNQIKKIENLEALTELEILDISFNLLRNIEGVDKLTRLKKLFLVNNKISK

SEQ ID NO: 68671 - protein, 289 aa, Homo sapiens
  Payload ID: 13669
  Gene Symbol: PPP1R7
  Gene Name: protein phosphatase 1, regulatory subunit 7
  ENSP ID: ENSP00000412092
MEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALP

SEQ ID NO: 68672 - protein, 108 aa, Homo sapiens
  Payload ID: 13669
  Gene Symbol: PPP1R7
  Gene Name: protein phosphatase 1, regulatory subunit 7
  ENSP ID: ENSP00000413360
  MOD_RES (1)..(1): Any amino acid
XDIASNRIKKIENISHLTELQEFWMNDNLLESWSDLDELKGARSLETVYLERNPLQKDPQYRRKVMLALPSVRQIDATFVRALLQRAPGRADCFHVCPSVLATSLACG

SEQ ID NO: 68673 - protein, 127 aa, Homo sapiens
  Payload ID: 13670
  Gene Symbol: PPP1R8
  Gene Name: protein phosphatase 1, regulatory subunit 8
  Uniprot ID: Q12972
  ENSP ID: ENSP00000236412
MVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 68674 - protein, 351 aa, Homo sapiens
  Payload ID: 13670
  Gene Symbol: PPP1R8
  Gene Name: protein phosphatase 1, regulatory subunit 8
  Uniprot ID: Q12972
  ENSP ID: ENSP00000311677
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 68675 - protein, 209 aa, Homo sapiens
  Payload ID: 13670
  Gene Symbol: PPP1R8
  Gene Name: protein phosphatase 1, regulatory subunit 8
  Uniprot ID: Q12972
  ENSP ID: ENSP00000363042
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 68676 - protein, 205 aa, Homo sapiens
  Payload ID: 13670
  Gene Symbol: PPP1R8
  Gene Name: protein phosphatase 1, regulatory subunit 8
  ENSP ID: ENSP00000410206
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTP

SEQ ID NO: 68677 - protein, 1296 aa, Homo sapiens
  Payload ID: 13671
  Gene Symbol: PPP1R9A
  Gene Name: protein phosphatase 1, regulatory subunit 9A
  Uniprot ID: Q9ULJ8
  ENSP ID: ENSP00000289495
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 68678 - protein, 1098 aa, Homo sapiens
  Payload ID: 13671
  Gene Symbol: PPP1R9A
  Gene Name: protein phosphatase 1, regulatory subunit 9A
  Uniprot ID: Q9ULJ8
  ENSP ID: ENSP00000344524
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKNFTFNDDFSPSSTSSADLSGLGAEPKTPGLSQSLALSSDESLDMIDDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 68679 - protein, 41 aa, Homo sapiens
  Payload ID: 13671
  Gene Symbol: PPP1R9A
  Gene Name: protein phosphatase 1, regulatory subunit 9A
  ENSP ID: ENSP00000398499
MLKTESSGERTTLRSASPHRNAYRTEFQALKSTFDKPKSDG

SEQ ID NO: 68680 - protein, 1098 aa, Homo sapiens; identical to SEQ ID NO: 68678
  Payload ID: 13671
  Gene Symbol: PPP1R9A
  Gene Name: protein phosphatase 1, regulatory subunit 9A
  Uniprot ID: Q9ULJ8
  ENSP ID: ENSP00000398870

SEQ ID NO: 68681 - protein, 1253 aa, Homo sapiens
  Payload ID: 13671
  Gene Symbol: PPP1R9A
  Gene Name: protein phosphatase 1, regulatory subunit 9A
  Uniprot ID: Q9ULJ8
  ENSP ID: ENSP00000402893
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKNFTFNDDFSPSSTSSADLSGLGAEPKTPGLSQSLALSSDEALGMTASQDRAVVKKKLKEMKMSLEKARKAQEKMEKQREKLRRKEQEQMQRKSKKTEKMTSTTAEGAGEQ

SEQ ID NO: 68682 - protein, 1374 aa, Homo sapiens
  Payload ID: 13671
  Gene Symbol: PPP1R9A
  Gene Name: protein phosphatase 1, regulatory subunit 9A
  Uniprot ID: Q9ULJ8
  ENSP ID: ENSP00000405514
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDENTVAELQGMSGNCNNNNNYFLKTGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 68683 - protein, 73 aa, Homo sapiens
  Payload ID: 13671
  Gene Symbol: PPP1R9A
  Gene Name: protein phosphatase 1, regulatory subunit 9A
  ENSP ID: ENSP00000405820
MLKTESSGERTTLRSASPHRNAYRTEFQALKSTFDKPKSDGEQKTKEGEGSQQSRGRKYGSNVNRIKNLFMQM

SEQ ID NO: 68684 - protein, 1253 aa, Homo sapiens; identical to SEQ ID NO: 68681
  Payload ID: 13671
  Gene Symbol: PPP1R9A
  Gene Name: protein phosphatase 1, regulatory subunit 9A
  Uniprot ID: Q9ULJ8
  ENSP ID: ENSP00000411342

SEQ ID NO: 68685 - protein, 817 aa, Homo sapiens
  Payload ID: 13672
  Gene Symbol: PPP1R9B
  Gene Name: protein phosphatase 1, regulatory subunit 9B
  ENSP ID: ENSP00000478767
MMKTEPRGPGGPLRSASPHRSAYEAGIQALKPPDAPGPDEAPKGAHHKKYGSNVHRIKSMFLQMGTTAGPSGEAGGGAGLAEAPRASERGVRLSLPRASSLNENVDHSALLKLGTSVSERVSRFDSKPAPSAQPAPPPHPPSRLQETRKLFERSAPAAAGGDKEAAARRLLRQERAGLQDRKLDVVVRFNGSTEALDKLDADAVSPTVSQLSAVFEKADSRTGLHRGPGLPRAAGVPQVNSKLVSKRSRVFQPPPPPPPAPSGDAPAEKERCPAGQQPPQHRVAPARPPPKPREVRKIKPVEVEESGESEAESAPGEVIQAEVTVHAALENGSTVATAASPAPEEPKAQAAPEKEAAAVAPPERGVGNGRAPDVAPEEVDESKKEDFSEADLVDVSAYSGLGEDSAGSALEEDDEDDEEDGEPPYEPESGCVEIPGLSEEEDPAPSRKIHFSTAPIQVFSTYSNEDYDRRNEDVDPMAASAEYELEKRVERLELFPVELEKDSEGLGISIIGMGAGADMGLEKLGIFVKTVTEGGAAHRDGRIQVNDLLVEVDGTSLVGVTQSFAASVLRNTKGRVRFMIGRERPGEQSEVAQLIQQTLEQERWQREMMEQRYAQYGEDDEETGEYATDEDEELSPTFPGGEMAIEVFELAENEDALSPVDMEPEKLVHKFKELQIKHAVTEAEIQQLKRKLQSLEQEKGRWRVEKAQLEQSVEENKERMEKLEGYWGEAQSLCQAVDEHLRETQAQYQALERKYSKAKRLIKDYQQKEIEFLKKETAQRRVLEESELARKEEMDKLLDKISELEGNLQTLRNSNST

SEQ ID NO: 68686 - protein, 309 aa, Homo sapiens
  Payload ID: 13673
  Gene Symbol: PPP2CA
  Gene Name: protein phosphatase 2, catalytic subunit, alpha isozyme
  Uniprot ID: P67775
  ENSP ID: ENSP00000418447
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 68687 - protein, 145 aa, Homo sapiens
  Payload ID: 13673
  Gene Symbol: PPP2CA
  Gene Name: protein phosphatase 2, catalytic subunit, alpha isozyme
  ENSP ID: ENSP00000428816
MPFNGSDVLNLLFLYPLTSNEAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTAL

SEQ ID NO: 68688 - protein, 126 aa, Homo sapiens
  Payload ID: 13673
  Gene Symbol: PPP2CA
  Gene Name: protein phosphatase 2, catalytic subunit, alpha isozyme
  ENSP ID: ENSP00000430869
MELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPH

SEQ ID NO: 68689 - protein, 309 aa, Homo sapiens
  Payload ID: 13674
  Gene Symbol: PPP2CB
  Gene Name: protein phosphatase 2, catalytic subunit, beta isozyme
  Uniprot ID: P62714
  ENSP ID: ENSP00000221138
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 68690 - protein, 47 aa, Homo sapiens
  Payload ID: 13674
  Gene Symbol: PPP2CB
  Gene Name: protein phosphatase 2, catalytic subunit, beta isozyme
  ENSP ID: ENSP00000428142
MDDKAFTKELDQWVEQLNECKQLNENQVRTLCEKAKEILTKESNVQE

SEQ ID NO: 68691 - protein, 184 aa, Homo sapiens
  Payload ID: 13674
  Gene Symbol: PPP2CB
  Gene Name: protein phosphatase 2, catalytic subunit, beta isozyme
  ENSP ID: ENSP00000428618
MTETRREGRERAREGERQVGRGRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHA

SEQ ID NO: 68692 - protein, 125 aa, Homo sapiens
  Payload ID: 13674
  Gene Symbol: PPP2CB
  Gene Name: protein phosphatase 2, catalytic subunit, beta isozyme
  ENSP ID: ENSP00000428866
MELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVP

SEQ ID NO: 68693 - protein, 52 aa, Homo sapiens
  Payload ID: 13674
  Gene Symbol: PPP2CB
  Gene Name: protein phosphatase 2, catalytic subunit, beta isozyme
  ENSP ID: ENSP00000429927
  MOD_RES (1)..(1): Any amino acid
XIFSAPNYCYRCGNQAAIMELDDTLKYSFLQFDPAPRRGEPHVTRRTPDYFL

SEQ ID NO: 68694 - protein, 124 aa, Homo sapiens
  Payload ID: 13674
  Gene Symbol: PPP2CB
  Gene Name: protein phosphatase 2, catalytic subunit, beta isozyme
  ENSP ID: ENSP00000430758
IFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSL

SEQ ID NO: 68695 - protein, 589 aa, Homo sapiens
  Payload ID: 13675
  Gene Symbol: PPP2R1A
  Gene Name: protein phosphatase 2, regulatory subunit A, alpha
  Uniprot ID: P30153
  ENSP ID: ENSP00000324804
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 68696 - protein, 132 aa, Homo sapiens
  Payload ID: 13675
  Gene Symbol: PPP2R1A
  Gene Name: protein phosphatase 2, regulatory subunit A, alpha
  ENSP ID: ENSP00000375668
  MOD_RES (1)..(1): Any amino acid
XAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTGKT

SEQ ID NO: 68697 - protein, 395 aa, Homo sapiens
  Payload ID: 13675
  Gene Symbol: PPP2R1A
  Gene Name: protein phosphatase 2, regulatory subunit A, alpha
  ENSP ID: ENSP00000391905
MAAADGDDSLYPIAVLIDELRNEDVQVRRLRGTWGRRGGVPGGTGGPRGEDSAFAGSGGRGRRPISLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPI

SEQ ID NO: 68698 - protein, 38 aa, Homo sapiens
  Payload ID: 13675
  Gene Symbol: PPP2R1A
  Gene Name: protein phosphatase 2, regulatory subunit A, alpha
  ENSP ID: ENSP00000469150
MAAADGDDSLYPIAVLIDELRNEDVQCWELLIIGEASW

SEQ ID NO: 68699 - protein, 410 aa, Homo sapiens
  Payload ID: 13675
  Gene Symbol: PPP2R1A
  Gene Name: protein phosphatase 2, regulatory subunit A, alpha
  ENSP ID: ENSP00000470504
MVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 68700 - protein, 66 aa, Homo sapiens
  Payload ID: 13675
  Gene Symbol: PPP2R1A
  Gene Name: protein phosphatase 2, regulatory subunit A, alpha
  ENSP ID: ENSP00000471298
MAAADGDDSLYPIAVLIDELRNEDVQRRGFTMLARLGRELLTSSDPPASASQSVGITGVSHRAQPG

SEQ ID NO: 68701 - protein, 38 aa, Homo sapiens; identical to SEQ ID NO: 68698
  Payload ID: 13675
  Gene Symbol: PPP2R1A
  Gene Name: protein phosphatase 2, regulatory subunit A, alpha
  ENSP ID: ENSP00000485914

SEQ ID NO: 68702 - protein, 667 aa, Homo sapiens
  Payload ID: 13676
  Gene Symbol: PPP2R1B
  Gene Name: protein phosphatase 2, regulatory subunit A, beta
  Uniprot ID: P30154
  ENSP ID: ENSP00000311344
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 68703 - protein, 556 aa, Homo sapiens
  Payload ID: 13676
  Gene Symbol: PPP2R1B
  Gene Name: protein phosphatase 2, regulatory subunit A, beta
  Uniprot ID: P30154
  ENSP ID: ENSP00000343317
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKCPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 68704 - protein, 474 aa, Homo sapiens
  Payload ID: 13676
  Gene Symbol: PPP2R1B
  Gene Name: protein phosphatase 2, regulatory subunit A, beta
  Uniprot ID: P30154
  ENSP ID: ENSP00000376775
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 68705 - protein, 603 aa, Homo sapiens
  Payload ID: 13676
  Gene Symbol: PPP2R1B
  Gene Name: protein phosphatase 2, regulatory subunit A, beta
  Uniprot ID: P30154
  ENSP ID: ENSP00000410671
MAGASELGTGPGAAGGDGDDSLYPIAVLIDELRNEDVQPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 68706 - protein, 83 aa, Homo sapiens
  Payload ID: 13676
  Gene Symbol: PPP2R1B
  Gene Name: protein phosphatase 2, regulatory subunit A, beta
  ENSP ID: ENSP00000432666
MAGASELGTGPGAAGGDGDDSLYPIAVLIDELRNEDVQLRLNSIKKLSTIALALGVERTRSELLPFLTASFGKSGNCGRDCCS

SEQ ID NO: 68707 - protein, 224 aa, Homo sapiens
  Payload ID: 13676
  Gene Symbol: PPP2R1B
  Gene Name: protein phosphatase 2, regulatory subunit A, beta
  ENSP ID: ENSP00000433598
  MOD_RES (1)..(1): Any amino acid
XNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLALSEACGQEITTKQMLPIVLKMAGDQVANVRFNVAKSLQKIGPILDTNALQGEVKPVLQKLGQDEDMDVKYFAQEAI

SEQ ID NO: 68708 - protein, 119 aa, Homo sapiens
  Payload ID: 13676
  Gene Symbol: PPP2R1B
  Gene Name: protein phosphatase 2, regulatory subunit A, beta
  ENSP ID: ENSP00000434705
MPRSPLKCPWIPSSRLGTGSACWLRLNSIKKLSTIALALGVERTRSELLPFLTDTIYDEDEVLLALAEQLGNFTGLVGGPDFAHCLLPPLENLATVEETVVRDKAVESLRQISQEHTPV

SEQ ID NO: 68709 - protein, 135 aa, Homo sapiens
  Payload ID: 13676
  Gene Symbol: PPP2R1B
  Gene Name: protein phosphatase 2, regulatory subunit A, beta
  ENSP ID: ENSP00000436626
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLTPSGNCHLGHEILAFLQKSCLWVGRTICYHCVS

SEQ ID NO: 68710 - protein, 601 aa, Homo sapiens
  Payload ID: 13676
  Gene Symbol: PPP2R1B
  Gene Name: protein phosphatase 2, regulatory subunit A, beta
  Uniprot ID: P30154
  ENSP ID: ENSP00000437193
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 68711 - protein, 457 aa, Homo sapiens
  Payload ID: 13677
  Gene Symbol: PPP2R2A
  Gene Name: protein phosphatase 2, regulatory subunit B, alpha
  Uniprot ID: P63151
  ENSP ID: ENSP00000325074
MFPKFSLRSMFHGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 68712 - protein, 447 aa, Homo sapiens
  Payload ID: 13677
  Gene Symbol: PPP2R2A
  Gene Name: protein phosphatase 2, regulatory subunit B, alpha
  Uniprot ID: P63151
  ENSP ID: ENSP00000370113
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 68713 - protein, 51 aa, Homo sapiens
  Payload ID: 13677
  Gene Symbol: PPP2R2A
  Gene Name: protein phosphatase 2, regulatory subunit B, alpha
  ENSP ID: ENSP00000428164
MAGAGGGNDIQWCFSQVKGAVDDDVAEGKKAFNAKFGYIIFAEMFPTGGFP

SEQ ID NO: 68714 - protein, 14 aa, Homo sapiens
  Payload ID: 13677
  Gene Symbol: PPP2R2A
  Gene Name: protein phosphatase 2, regulatory subunit B, alpha
  ENSP ID: ENSP00000428165
MDLMVEASPRRIFA

SEQ ID NO: 68715 - protein, 33 aa, Homo sapiens
  Payload ID: 13677
  Gene Symbol: PPP2R2A
  Gene Name: protein phosphatase 2, regulatory subunit B, alpha
  ENSP ID: ENSP00000428542
MAGAGGGNDIQWCFSQVKGAVDDDVAEDHLFET

SEQ ID NO: 68716 - protein, 3 aa, Homo sapiens
  Payload ID: 13677
  Gene Symbol: PPP2R2A
  Gene Name: protein phosphatase 2, regulatory subunit B, alpha
  ENSP ID: ENSP00000428705
MDL

SEQ ID NO: 68717 - protein, 5 aa, Homo sapiens
  Payload ID: 13677
  Gene Symbol: PPP2R2A
  Gene Name: protein phosphatase 2, regulatory subunit B, alpha
  ENSP ID: ENSP00000428800
MDLMV

SEQ ID NO: 68718 - protein, 132 aa, Homo sapiens
  Payload ID: 13677
  Gene Symbol: PPP2R2A
  Gene Name: protein phosphatase 2, regulatory subunit B, alpha
  ENSP ID: ENSP00000429279
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNVQAGFSDSLPKNRIWQG

SEQ ID NO: 68719 - protein, 197 aa, Homo sapiens
  Payload ID: 13677
  Gene Symbol: PPP2R2A
  Gene Name: protein phosphatase 2, regulatory subunit B, alpha
  ENSP ID: ENSP00000430320
MEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKK

SEQ ID NO: 68720 - protein, 33 aa, Homo sapiens
  Payload ID: 13677
  Gene Symbol: PPP2R2A
  Gene Name: protein phosphatase 2, regulatory subunit B, alpha
  ENSP ID: ENSP00000486025
FPGAGGGNDIQWCFSQVKGAVDDDVAEVGIFQT

SEQ ID NO: 68721 - protein, 486 aa, Homo sapiens
  Payload ID: 13678
  Gene Symbol: PPP2R5A
  Gene Name: protein phosphatase 2, regulatory subunit B', alpha
  Uniprot ID: Q15172
  ENSP ID: ENSP00000261461
MSSSSPPAGAASAAISASEKVDGFTRKSVRKAQRQKRSQGSSQFRSQGSQAELHPLPQLKDATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 68722 - protein, 429 aa, Homo sapiens
  Payload ID: 13678
  Gene Symbol: PPP2R5A
  Gene Name: protein phosphatase 2, regulatory subunit B', alpha
  Uniprot ID: Q15172
  ENSP ID: ENSP00000442866
MIMNATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 68723 - protein, 1150 aa, Homo sapiens
  Payload ID: 13679
  Gene Symbol: PPP2R3A
  Gene Name: protein phosphatase 2, regulatory subunit B'', alpha
  Uniprot ID: Q06190
  ENSP ID: ENSP00000264977
MAATYRLVVSTVNHYSSVVIDRRFEQAIHYCTGTCHTFTHGIDCIVVHHSVCADLLHIPVSQFKDADLNSMFLPHENGLSSAEGDYPQQAFTGIPRVKRGSTFQNTYNLKDIAGEAISFASGKIKEFSFEKLKNSNHAAYRKGRKVKSDSFNRRSVDLDLLCGHYNNDGNAPSFGLLRSSSVEEKPLSHRNSLDTNLTSMFLQNFSEEDLVTQILEKHKIDNFSSGTDIKMCLDILLKCSEDLKKCTDIIKQCIKKKSGSSISEGSGNDTISSSETVYMNVMTRLASYLKKLPFEFMQSGNNEALDLTELISNMPSLQLTPFSPVFGTEQPPKYEDVVQLSASDSGRFQTIELQNDKPNSRKMDTVQSIPNNSTNSLYNLEVNDPRTLKAVQVQSQSLTMNPLENVSSDDLMETLYIEEESDGKKALDKGQKTENGPSHELLKVNEHRAEFPEHATHLKKCPTPMQNEIGKIFEKSFVNLPKEDCKSKVSKFEEGDQRDFTNSSSQEEIDKLLMDLESFSQKMETSLREPLAKGKNSNFLNSHSQLTGQTLVDLEPKSKVSSPIEKVSPSCLTRIIETNGHKIEEEDRALLLRILESIEDFAQELVECKSSRGSLSQEKEMMQILQETLTTSSQANLSVCRSPVGDKAKDTTSAVLIQQTPEVIKIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 68724 - protein, 529 aa, Homo sapiens
  Payload ID: 13679
  Gene Symbol: PPP2R3A
  Gene Name: protein phosphatase 2, regulatory subunit B'', alpha
  Uniprot ID: Q06190
  ENSP ID: ENSP00000334748
MMIKETSLRRDPDLRGELAFLARGCDFVLPSRFKKRLKSFQQTQIQNKPEKKPGTPLPPPATSPSSPRPLSPVPHVNNVVNAPLSINIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 68725 - protein, 191 aa, Homo sapiens
  Payload ID: 13679
  Gene Symbol: PPP2R3A
  Gene Name: protein phosphatase 2, regulatory subunit B'', alpha
  ENSP ID: ENSP00000400980
  MOD_RES (1)..(1): Any amino acid
XNIPRFYFPEGLPDTCSNHEQTLSRIETAFMDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQSNEDLAKLAVHDGYTNIFLF

SEQ ID NO: 68726 - protein, 414 aa, Homo sapiens
  Payload ID: 13679
  Gene Symbol: PPP2R3A
  Gene Name: protein phosphatase 2, regulatory subunit B'', alpha
  Uniprot ID: Q06190
  ENSP ID: ENSP00000419344
MDIEEQKADIYEMGKIAKVCGCPLYWKAPMFRAAGGEKTGFVTAQSFIAMWRKLLNNHHDDASKFICLLAKPNCSSLEQEDFIPLLQDVVDTHPGLTFLKDAPEFHSRYITTVIQRIFYTVNRSWSGKITSTEIRKSNFLQTLALLEEEEDINQITDYFSYEHFYVIYCKFWELDTDHDLYISQADLSRYNDQASSSRIIERIFSGAVTRGKTIQKEGRMSYADFVWFLISEEDKRNPTSIEYWFRCMDVDGDGVLSMYELEYFYEEQCERMEAMGIEPLPFHDLLCQMLDLVKPAVDGKITLRDLKRCRMAHIFYDTFFNLEKYLDHEQRDPFAVQKDVENDGPEPSDWDRFAAEEYETLVAEESAQAQFQEGFEDYETDEPASPSEFGNKSNKILSASLPEKCGKLQSVDEE

SEQ ID NO: 68727 - protein, 446 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000336591
MKCFSRYLPYIFRPPNTILSSSCHTEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68728 - protein, 443 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000377931
MEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68729 - protein, 443 aa, Homo sapiens; identical to SEQ ID NO: 68728
  Payload ID: 13680
  Gene Symbol: PPP2R2B
  Gene Name: protein phosphatase 2, regulatory subunit B, beta
  Uniprot ID: Q00005
  ENSP ID: ENSP00000377933

SEQ ID NO: 68730 - protein, 501 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000377935
MVLQPSERHYRDWNHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68731 - protein, 509 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000377936
MLLSLPALHLQTSEHHPFFQLPHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68732 - protein, 432 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000398779
MNYPDENTYGNKADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68733 - protein, 58 aa, Homo sapiens
  Payload ID: 13680
  Gene Symbol: PPP2R2B
  Gene Name: protein phosphatase 2, regulatory subunit B, beta
  ENSP ID: ENSP00000421224
MQNSDIISTVEFNHTGELLATGDKGGRVVIFQREQESKNQVHRRGEYNVYSTFQSHEP

SEQ ID NO: 68734 - protein, 449 aa, Homo sapiens
  Payload ID: 13680
  Gene Symbol: PPP2R2B
  Gene Name: protein phosphatase 2, regulatory subunit B, beta
  Uniprot ID: Q00005
  ENSP ID: ENSP00000421396
MIPGIGTLTQDTLWCFSQVKGTIEIGTTEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 68735 - protein, 37 aa, Homo sapiens
  Payload ID: 13680
  Gene Symbol: PPP2R2B
  Gene Name: protein phosphatase 2, regulatory subunit B, beta
  ENSP ID: ENSP00000421577
MKCFSRYLPYIFRPPNTILSSSCHTEGRILRLGAVCL

SEQ ID NO: 68736 - protein, 49 aa, Homo sapiens
  Payload ID: 13680
  Gene Symbol: PPP2R2B
  Gene Name: protein phosphatase 2, regulatory subunit B, beta
  ENSP ID: ENSP00000424409
MKCFSRYLPYIFRPPNTILSSSCHTEGNSSFLEIGPIYTQNELKRLRCY

SEQ ID NO: 68737 - protein, 40 aa, Homo sapiens
  Payload ID: 13680
  Gene Symbol: PPP2R2B
  Gene Name: protein phosphatase 2, regulatory subunit B, beta
  ENSP ID: ENSP00000425413
MQNCSDHGAVPLAPLPPSPVRLAAGRDHGYLSAGFWFPRK

SEQ ID NO: 68738 - protein, 78 aa, Homo sapiens
  Payload ID: 13680
  Gene Symbol: PPP2R2B
  Gene Name: protein phosphatase 2, regulatory subunit B, beta
  ENSP ID: ENSP00000425828
  MOD_RES (1)..(1): Any amino acid
XGRYIMTRDYLTVKVWDLNMENRPIETYQVHDYLRSKLCSLYENDCIFDKFECVWNGSDRLGRSLHVAKDPSHTDQLV

SEQ ID NO: 68739 - protein, 44 aa, Homo sapiens
  Payload ID: 13680
  Gene Symbol: PPP2R2B
  Gene Name: protein phosphatase 2, regulatory subunit B, beta
  ENSP ID: ENSP00000426599
MEEDIDTRKINNSFLRDHSYATEGAKGEPKTENSGPIMKHELSR

SEQ ID NO: 68740 - protein, 432 aa, Homo sapiens; identical to SEQ ID NO: 68732
  Payload ID: 13680
  Gene Symbol: PPP2R2B
  Gene Name: protein phosphatase 2, regulatory subunit B, beta
  Uniprot ID: Q00005
  ENSP ID: ENSP00000431320

SEQ ID NO: 68741 - protein, 44 aa, Homo sapiens; identical to SEQ ID NO: 68739
  Payload ID: 13680
  Gene Symbol: PPP2R2B
  Gene Name: protein phosphatase 2, regulatory subunit B, beta
  ENSP ID: ENSP00000433890

SEQ ID NO: 68742 - protein, 44 aa, Homo sapiens; identical to SEQ ID NO: 68739
  Payload ID: 13680
  Gene Symbol: PPP2R2B
  Gene Name: protein phosphatase 2, regulatory subunit B, beta
  ENSP ID: ENSP00000434497

SEQ ID NO: 68743 - protein, 497 aa, Homo sapiens
  Payload ID: 13681
  Gene Symbol: PPP2R5B
  Gene Name: protein phosphatase 2, regulatory subunit B', beta
  Uniprot ID: Q15173
  ENSP ID: ENSP00000164133
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 68744 - protein, 111 aa, Homo sapiens
  Payload ID: 13681
  Gene Symbol: PPP2R5B
  Gene Name: protein phosphatase 2, regulatory subunit B', beta
  ENSP ID: ENSP00000436136
MFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLM

SEQ ID NO: 68745 - protein, 193 aa, Homo sapiens
  Payload ID: 13681
  Gene Symbol: PPP2R5B
  Gene Name: protein phosphatase 2, regulatory subunit B', beta
  ENSP ID: ENSP00000437088
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQK

SEQ ID NO: 68746 - protein, 169 aa, Homo sapiens
  Payload ID: 13682
  Gene Symbol: PPP2R3B
  Gene Name: protein phosphatase 2, regulatory subunit B'', beta
  ENSP ID: ENSP00000371038
MERAEPGPRLQRPAGPGPALPRERGARPGPRRALRAGGMRLRERSLRQDPDLRQELASLARGCDFVLPSRFKKRLKAFQQVQTRKEEPLPPATSQSIPTFYFPRGRPQDSVNVDAVISKIESTFARFPHERATMDDMGLVAKACGCPLYWKGPLFYGAGGERTGSVSVH

SEQ ID NO: 68747 - protein, 575 aa, Homo sapiens
  Payload ID: 13682
  Gene Symbol: PPP2R3B
  Gene Name: protein phosphatase 2, regulatory subunit B'', beta
  Uniprot ID: Q9Y5P8
  ENSP ID: ENSP00000375080
MPPGKVLQPVLKMKVDELFLYWLSEASTQRMLQDCLRRIKAPGRDQPTPGDGEQPGAWPTAPLAAPRPSGLEPPGTPGPGPALPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 68748 - protein, 575 aa, Homo sapiens
  Payload ID: 13682
  Gene Symbol: PPP2R3B
  Gene Name: protein phosphatase 2, regulatory subunit B'', beta
  ENSP ID: ENSP00000480675
MPPGKVLQPVLKMKVDELFLYWLSEASTQRMLQDCLRRIKAPGRDQPTPGDGEQPGAWPTAPLAAPRPSGLEPPGTPGPGPALPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFGELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 68749 - protein, 575 aa, Homo sapiens
  Payload ID: 13682
  Gene Symbol: PPP2R3B
  Gene Name: protein phosphatase 2, regulatory subunit B'', beta
  ENSP ID: ENSP00000481962
MPPGKVLQPVLKMKVDELFLYWLSEASTQRMLQDCLRRIKAPGRDQPTPGDGEQPGAWPTAPLAAPRPSGLEPPGTPGPGPALPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETVGEPWEDGFEAELSPVEQKLSALRSPLAQRPFFEAPSPLGAVDLYEYACGDEDLEPL

SEQ ID NO: 68750 - protein, 169 aa, Homo sapiens; identical to SEQ ID NO: 68746
  Payload ID: 13682
  Gene Symbol: PPP2R3B
  Gene Name: protein phosphatase 2, regulatory subunit B'', beta
  ENSP ID: ENSP00000485689

SEQ ID NO: 68751 - protein, 169 aa, Homo sapiens; identical to SEQ ID NO: 68746
  Payload ID: 13682
  Gene Symbol: PPP2R3B
  Gene Name: protein phosphatase 2, regulatory subunit B'', beta
  ENSP ID: ENSP00000487375

SEQ ID NO: 68752 - protein, 453 aa, Homo sapiens
  Payload ID: 13683
  Gene Symbol: PPP2R2D
  Gene Name: protein phosphatase 2, regulatory subunit B, delta
  Uniprot ID: Q66LE6
  ENSP ID: ENSP00000399970
MAGAGGGGCPAGGNDFQWCFSQVKGAIDEDVAEADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 68753 - protein, 150 aa, Homo sapiens
  Payload ID: 13683
  Gene Symbol: PPP2R2D
  Gene Name: protein phosphatase 2, regulatory subunit B, delta
  ENSP ID: ENSP00000428418
  MOD_RES (1)..(1): Any amino acid
XGNDFQWCFSQVKGAIDEDVAEADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRMT

SEQ ID NO: 68754 - protein, 77 aa, Homo sapiens
  Payload ID: 13683
  Gene Symbol: PPP2R2D
  Gene Name: protein phosphatase 2, regulatory subunit B, delta
  ENSP ID: ENSP00000481133
MAGAGGGGCPAGGNDFQWCFSQVKGAIDEDVAEADIISTVEFNYSGDLLATGDKGGRVVIFQREQEVLAQPRRPALP

SEQ ID NO: 68755 - protein, 57 aa, Homo sapiens
  Payload ID: 13683
  Gene Symbol: PPP2R2D
  Gene Name: protein phosphatase 2, regulatory subunit B, delta
  ENSP ID: ENSP00000485636
SQVKGAIDEDVAEGRGEESSGLLPQIMLSRQQLHLPLALLIRGNDNSVKTADDVQGL

SEQ ID NO: 68756 - protein, 111 aa, Homo sapiens
  Payload ID: 13684
  Gene Symbol: PPP2R5D
  Gene Name: protein phosphatase 2, regulatory subunit B', delta
  ENSP ID: ENSP00000230402
MPYKLKKEKEPPKVAKCTAKPSSSGKDGGGENTEEVTCLTRPSRSPSPSPSPKPSLSHRHPTSVPAIARRPPRSSAKSSTQGGPRLSRRSDGKAPPASTSARIGSCRSFLP

SEQ ID NO: 68757 - protein, 570 aa, Homo sapiens
  Payload ID: 13684
  Gene Symbol: PPP2R5D
  Gene Name: protein phosphatase 2, regulatory subunit B', delta
  Uniprot ID: Q14738
  ENSP ID: ENSP00000377669
MPYKLKKEKEPPKVAKCTAKPSSSGKDGGGENTEEAQPQPQPQPQPQAQSQPPSSNKRPSNSTPPPTQLSKIKYSGGPQIVKKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 68758 - protein, 602 aa, Homo sapiens
  Payload ID: 13684
  Gene Symbol: PPP2R5D
  Gene Name: protein phosphatase 2, regulatory subunit B', delta
  Uniprot ID: Q14738
  ENSP ID: ENSP00000417963
MPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 68759 - protein, 504 aa, Homo sapiens
  Payload ID: 13684
  Gene Symbol: PPP2R5D
  Gene Name: protein phosphatase 2, regulatory subunit B', delta
  ENSP ID: ENSP00000419756
  MOD_RES (1)..(1): Any amino acid
XKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 68760 - protein, 154 aa, Homo sapiens
  Payload ID: 13684
  Gene Symbol: PPP2R5D
  Gene Name: protein phosphatase 2, regulatory subunit B', delta
  ENSP ID: ENSP00000420529
  MOD_RES (1)..(1): Any amino acid
XFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQNPTPILLLLLRGRFRMKEREEMWQKIEELARLNPQYPMF

SEQ ID NO: 68761 - protein, 594 aa, Homo sapiens
  Payload ID: 13684
  Gene Symbol: PPP2R5D
  Gene Name: protein phosphatase 2, regulatory subunit B', delta
  ENSP ID: ENSP00000420550
MPYKLKKEKEPPKVAKCTAKPSSSGKDGGGENTEEPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 68762 - protein, 496 aa, Homo sapiens
  Payload ID: 13684
  Gene Symbol: PPP2R5D
  Gene Name: protein phosphatase 2, regulatory subunit B', delta
  Uniprot ID: Q14738
  ENSP ID: ENSP00000420674
MPYKLKKEKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 68763 - protein, 467 aa, Homo sapiens
  Payload ID: 13685
  Gene Symbol: PPP2R5E
  Gene Name: protein phosphatase 2, regulatory subunit B', epsilon isoform
  Uniprot ID: Q16537
  ENSP ID: ENSP00000337641
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 68764 - protein, 391 aa, Homo sapiens
  Payload ID: 13685
  Gene Symbol: PPP2R5E
  Gene Name: protein phosphatase 2, regulatory subunit B', epsilon isoform
  Uniprot ID: Q16537
  ENSP ID: ENSP00000404632
MDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 68765 - protein, 462 aa, Homo sapiens
  Payload ID: 13685
  Gene Symbol: PPP2R5E
  Gene Name: protein phosphatase 2, regulatory subunit B', epsilon isoform
  Uniprot ID: Q16537
  ENSP ID: ENSP00000452396
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYNEKKKEKEREELWKKLEDLELKRGLRRDGIIPT

SEQ ID NO: 68766 - protein, 447 aa, Homo sapiens
  Payload ID: 13686
  Gene Symbol: PPP2R2C
  Gene Name: protein phosphatase 2, regulatory subunit B, gamma
  Uniprot ID: Q9Y2T4
  ENSP ID: ENSP00000335083
MGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 68767 - protein, 447 aa, Homo sapiens
  Payload ID: 13686
  Gene Symbol: PPP2R2C
  Gene Name: protein phosphatase 2, regulatory subunit B, gamma
  Uniprot ID: Q9Y2T4
  ENSP ID: ENSP00000372042
MGEDTDTRKINHSFLRDHSYVTEADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 68768 - protein, 430 aa, Homo sapiens
  Payload ID: 13686
  Gene Symbol: PPP2R2C
  Gene Name: protein phosphatase 2, regulatory subunit B, gamma
  Uniprot ID: Q9Y2T4
  ENSP ID: ENSP00000422374
MGKRDTADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 68769 - protein, 440 aa, Homo sapiens
  Payload ID: 13686
  Gene Symbol: PPP2R2C
  Gene Name: protein phosphatase 2, regulatory subunit B, gamma
  Uniprot ID: Q9Y2T4
  ENSP ID: ENSP00000423649
MREADTLRPPQLMEVSADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 68770 - protein, 42 aa, Homo sapiens
  Payload ID: 13686
  Gene Symbol: PPP2R2C
  Gene Name: protein phosphatase 2, regulatory subunit B, gamma
  ENSP ID: ENSP00000423650
MGLSFFSKHLPIQEGQPWALKTPADIISTVEFNHTGELLATE

SEQ ID NO: 68771 - protein, 440 aa, Homo sapiens; identical to SEQ ID NO: 68769
  Payload ID: 13686
  Gene Symbol: PPP2R2C
  Gene Name: protein phosphatase 2, regulatory subunit B, gamma
  Uniprot ID: Q9Y2T4
  ENSP ID: ENSP00000425247

SEQ ID NO: 68772 - protein, 485 aa, Homo sapiens
  Payload ID: 13687
  Gene Symbol: PPP2R5C
  Gene Name: protein phosphatase 2, regulatory subunit B', gamma
  Uniprot ID: Q13362
  ENSP ID: ENSP00000262239
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 68773 - protein, 540 aa, Homo sapiens
  Payload ID: 13687
  Gene Symbol: PPP2R5C
  Gene Name: protein phosphatase 2, regulatory subunit B', gamma
  Uniprot ID: Q13362
  ENSP ID: ENSP00000329009
MPNKNKKEKESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 68774 - protein, 524 aa, Homo sapiens
  Payload ID: 13687
  Gene Symbol: PPP2R5C
  Gene Name: protein phosphatase 2, regulatory subunit B', gamma
  Uniprot ID: Q13362
  ENSP ID: ENSP00000333905
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 68775 - protein, 449 aa, Homo sapiens
  Payload ID: 13687
  Gene Symbol: PPP2R5C
  Gene Name: protein phosphatase 2, regulatory subunit B', gamma
  Uniprot ID: Q13362
  ENSP ID: ENSP00000408389
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 68776 - protein, 555 aa, Homo sapiens
  Payload ID: 13687
  Gene Symbol: PPP2R5C
  Gene Name: protein phosphatase 2, regulatory subunit B', gamma
  Uniprot ID: Q13362
  ENSP ID: ENSP00000412324
MPNKNKKEKESPKAGKSGKSSKEGQDTVESEGTSPEEPSSPKVPPPLLPELLVLIFGGLQGRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 68777 - protein, 124 aa, Homo sapiens
  Payload ID: 13687
  Gene Symbol: PPP2R5C
  Gene Name: protein phosphatase 2, regulatory subunit B', gamma
  ENSP ID: ENSP00000450525
MPNKNKKEKESPKAGKSGKSSKEGQDTVESEQISVRKNSLVAVPSTVSAKIKVPVSQPIVKKDKRQNSSRFSASNNRELQKLPSLKDCKCTRFETYVYRGPTFHTHGFCGPTVGLEYAWIWLRL

SEQ ID NO: 68778 - protein, 45 aa, Homo sapiens
  Payload ID: 13687
  Gene Symbol: PPP2R5C
  Gene Name: protein phosphatase 2, regulatory subunit B', gamma
  ENSP ID: ENSP00000450626
  MOD_RES (1)..(1): Any amino acid
XFDDCTQQFKAEKLKEKLKMKEREEAWVKIENLAKANPQACRGSA

SEQ ID NO: 68779 - protein, 71 aa, Homo sapiens
  Payload ID: 13687
  Gene Symbol: PPP2R5C
  Gene Name: protein phosphatase 2, regulatory subunit B', gamma
  ENSP ID: ENSP00000450743
FAVNMFRTLPPSSNPTGAEFDPEEDEPTLEAAWPHLQLVYEFFLRFLESPDFQPNIAKKYIDQKFVLQVYL

SEQ ID NO: 68780 - protein, 151 aa, Homo sapiens
  Payload ID: 13687
  Gene Symbol: PPP2R5C
  Gene Name: protein phosphatase 2, regulatory subunit B', gamma
  ENSP ID: ENSP00000450816
  MOD_RES (1)..(1): Any amino acid
XNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQGLALIPRLECSGTILAHCSLGLLDSSNPPTSASQAAVTTGTTTLS

SEQ ID NO: 68781 - protein, 216 aa, Homo sapiens
  Payload ID: 13687
  Gene Symbol: PPP2R5C
  Gene Name: protein phosphatase 2, regulatory subunit B', gamma
  ENSP ID: ENSP00000450867
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLLELFDSEDPRERDFLKTTLHRIYGKFLGLRAYIRKQINNIFYRFIYETEHHNGIAELLEILGSIINGFALPLKEEHKIFL

SEQ ID NO: 68782 - protein, 553 aa, Homo sapiens
  Payload ID: 13687
  Gene Symbol: PPP2R5C
  Gene Name: protein phosphatase 2, regulatory subunit B', gamma
  ENSP ID: ENSP00000450931
NKNKKEKESPKAGKSGKSSKEGQDTVESEGTSPEEPSSPKVPPPLLPELLVLIFGGLQGRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 68783 - protein, 384 aa, Homo sapiens
  Payload ID: 13687
  Gene Symbol: PPP2R5C
  Gene Name: protein phosphatase 2, regulatory subunit B', gamma
  ENSP ID: ENSP00000451179
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNK

SEQ ID NO: 68784 - protein, 153 aa, Homo sapiens
  Payload ID: 13687
  Gene Symbol: PPP2R5C
  Gene Name: protein phosphatase 2, regulatory subunit B', gamma
  ENSP ID: ENSP00000452124
KQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQREAKNERTGRSMG

SEQ ID NO: 68785 - protein, 46 aa, Homo sapiens
  Payload ID: 13687
  Gene Symbol: PPP2R5C
  Gene Name: protein phosphatase 2, regulatory subunit B', gamma
  ENSP ID: ENSP00000452500
MLTCNKAGSRMVVDAANSNGPFQPVVLLHIRGTVPTCSVAQPQSSC

SEQ ID NO: 68786 - protein, 69 aa, Homo sapiens
  Payload ID: 13687
  Gene Symbol: PPP2R5C
  Gene Name: protein phosphatase 2, regulatory subunit B', gamma
  ENSP ID: ENSP00000452533
QPNIAKKYIDQKFVLQLLELFDSEDPRERDFLKTTLHRIYGKFLGLRAYIRKQINNIFYRCLKFSKIKY

SEQ ID NO: 68787 - protein, 69 aa, Homo sapiens
  Payload ID: 13687
  Gene Symbol: PPP2R5C
  Gene Name: protein phosphatase 2, regulatory subunit B', gamma
  ENSP ID: ENSP00000452630
MLTCNKAGSRMVVDAANSNGPFQPVVLLHIRDCKCTRFETYVYRGPTFHTHGFCGPTVGLEYAWIWLRL

SEQ ID NO: 68788 - protein, 146 aa, Homo sapiens
  Payload ID: 13687
  Gene Symbol: PPP2R5C
  Gene Name: protein phosphatase 2, regulatory subunit B', gamma
  ENSP ID: ENSP00000452632
  MOD_RES (1)..(1): Any amino acid
XGKSSKEGQDTVESEQISVRKNSLVAVPSTVSAKIKVPVSQPIVKKDKRQNSSRFSASNNRELQKLPSLKVEAVKLGRVSAELRLEVPDLQLWPPTEQQGEQTHGEPRGPQSMDGAASLLPCPSSSTPDLPAFSPALLPLLPTCQP

SEQ ID NO: 68789 - protein, 29 aa, Homo sapiens
  Payload ID: 13687
  Gene Symbol: PPP2R5C
  Gene Name: protein phosphatase 2, regulatory subunit B', gamma
  ENSP ID: ENSP00000453875
DKRQNSSRFSASNNRELQKLPSLKGPPTL

SEQ ID NO: 68790 - protein, 89 aa, Homo sapiens
  Payload ID: 13687
  Gene Symbol: PPP2R5C
  Gene Name: protein phosphatase 2, regulatory subunit B', gamma
  ENSP ID: ENSP00000453906
LAKCVSSPHFQVAERALYYWNNEYIMSLISDNAAKILPIMFPSLYRNSKTHWNKTIHGLIYNALKLFMEMNQKLFDDCTQQFKAEKLKS

SEQ ID NO: 68791 - protein, 68 aa, Homo sapiens
  Payload ID: 13687
  Gene Symbol: PPP2R5C
  Gene Name: protein phosphatase 2, regulatory subunit B', gamma
  ENSP ID: ENSP00000454035
MPNKNKKEKESPKAGKSGKSSKEGQDTVESECYCLRAGATELEITTENTEMLGPSLLPHKDTRGNLAY

SEQ ID NO: 68792 - protein, 107 aa, Homo sapiens
  Payload ID: 13687
  Gene Symbol: PPP2R5C
  Gene Name: protein phosphatase 2, regulatory subunit B', gamma
  ENSP ID: ENSP00000454124
MLTCNKAGSRMVVDAANSNGPFQPVVLLHIRVEAVKLGRVSAELRLEVPDLQLWPPTEQQGEQTHGEPRGPQSMDGAASLLPCPSSSTPDLPAFSPALLPLLPTCQP

SEQ ID NO: 68793 - protein, 453 aa, Homo sapiens
  Payload ID: 13688
  Gene Symbol: PPP2R3C
  Gene Name: protein phosphatase 2, regulatory subunit B'', gamma
  Uniprot ID: Q969Q6
  ENSP ID: ENSP00000261475
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENREALVANDSENSADLDDT

SEQ ID NO: 68794 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000450429
MDWKEVLRRRLATPNTCPNTAC

SEQ ID NO: 68795 - protein, 41 aa, Homo sapiens
  Payload ID: 13688
  Gene Symbol: PPP2R3C
  Gene Name: protein phosphatase 2, regulatory subunit B'', gamma
  ENSP ID: ENSP00000450649
  MOD_RES (1)..(1): Any amino acid
XALENRKEPAALQYIFKLLDIENKGYLNVFSLNYFFRIYFY

SEQ ID NO: 68796 - protein, 226 aa, Homo sapiens
  Payload ID: 13688
  Gene Symbol: PPP2R3C
  Gene Name: protein phosphatase 2, regulatory subunit B'', gamma
  ENSP ID: ENSP00000450716
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLE

SEQ ID NO: 68797 - protein, 167 aa, Homo sapiens
  Payload ID: 13688
  Gene Symbol: PPP2R3C
  Gene Name: protein phosphatase 2, regulatory subunit B'', gamma
  ENSP ID: ENSP00000450815
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRK

SEQ ID NO: 68798 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000451075
MDWKEVLRRRLATPNTCPNTAC

SEQ ID NO: 68799 - protein, 226 aa, Homo sapiens
  Payload ID: 13688
  Gene Symbol: PPP2R3C
  Gene Name: protein phosphatase 2, regulatory subunit B'', gamma
  ENSP ID: ENSP00000451174
  MOD_RES (1)..(1): Any amino acid
XLPAEDEVLLQKLREESRAVFLQRKSRELLDNEELQTPPMIGEEAMINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEE

SEQ ID NO: 68800 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000451416
MDWKEVLRRRLATPNTCPNTAC

SEQ ID NO: 68801 - protein, 53 aa, Homo sapiens
  Payload ID: 13688
  Gene Symbol: PPP2R3C
  Gene Name: protein phosphatase 2, regulatory subunit B'', gamma
  ENSP ID: ENSP00000451423
MDWKEVLRRRLATPNTCPNSRETVIMRLKLHEVRGWGCLAHPSFRVYYSVLCT

SEQ ID NO: 68802 - protein, 29 aa, Homo sapiens
  Payload ID: 13688
  Gene Symbol: PPP2R3C
  Gene Name: protein phosphatase 2, regulatory subunit B'', gamma
  ENSP ID: ENSP00000451450
MDWKEVLRRRLATPNTCPNKIYLVFSAAC

SEQ ID NO: 68803 - protein, 190 aa, Homo sapiens
  Payload ID: 13688
  Gene Symbol: PPP2R3C
  Gene Name: protein phosphatase 2, regulatory subunit B'', gamma
  ENSP ID: ENSP00000451523
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRKGDSFLLCLNSLSGNQVGFWSVLL

SEQ ID NO: 68804 - protein, 19 aa, Homo sapiens
  Payload ID: 13688
  Gene Symbol: PPP2R3C
  Gene Name: protein phosphatase 2, regulatory subunit B'', gamma
  ENSP ID: ENSP00000451994
  MOD_RES (1)..(1): Any amino acid
XEVLRRRLATPNTCPNTAC

SEQ ID NO: 68805 - protein, 128 aa, Homo sapiens
  Payload ID: 13688
  Gene Symbol: PPP2R3C
  Gene Name: protein phosphatase 2, regulatory subunit B'', gamma
  ENSP ID: ENSP00000452173
GQYLNLDKDHNGMLSKEELSRYGTATMTNVFLDRVFQECLTYDGEMAIQELMKIHGQDPVSFQDVKDEIFDMVKPKDPLKISLQDLINSNQGDTVTTILIDLNGFWTYENREALVANDSENSADLDDT

SEQ ID NO: 68806 - protein, 134 aa, Homo sapiens
  Payload ID: 13688
  Gene Symbol: PPP2R3C
  Gene Name: protein phosphatase 2, regulatory subunit B'', gamma
  ENSP ID: ENSP00000452194
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKAIFHSKSLC

SEQ ID NO: 68807 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000452263
MDWKEVLRRRLATPNTCPNTAC

SEQ ID NO: 68808 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000452266
MDWKEVLRRRLATPNTCPNTAC

SEQ ID NO: 68809 - protein, 22 aa, Homo sapiens
  Payload ID: 13688
  Gene Symbol: PPP2R3C
  Gene Name: protein phosphatase 2, regulatory subunit B'', gamma
  ENSP ID: ENSP00000452436
MDWKEVLRRRLATPNTCPNTAC

SEQ ID NO: 68810 - protein, 106 aa, Homo sapiens
  Payload ID: 13688
  Gene Symbol: PPP2R3C
  Gene Name: protein phosphatase 2, regulatory subunit B'', gamma
  ENSP ID: ENSP00000452534
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQAIFHSKSLC

SEQ ID NO: 68811 - protein, 329 aa, Homo sapiens
  Payload ID: 13689
  Gene Symbol: PPP2R4
  Gene Name: protein phosphatase 2A activator, regulatory subunit 4
  ENSP ID: ENSP00000335200
MAEGERQPPPDSSEEAPPATQNFIIPKKEIHTVPDMGKWKRSQVPFGTVAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68812 - protein, 104 aa, Homo sapiens
  Payload ID: 13689
  Gene Symbol: PPP2R4
  Gene Name: protein phosphatase 2A activator, regulatory subunit 4
  ENSP ID: ENSP00000337412
MAEGERQPPPDSSEEAPPATQNFIIPKKEIHTVPDMGKWKRSQMKTGPFAEHSNQLWNISAVPSWSKVNQGLIRMYKAECLEKFPVIQHFKFGSLLPIHPVTSG

SEQ ID NO: 68813 - protein, 358 aa, Homo sapiens
  Payload ID: 13689
  Gene Symbol: PPP2R4
  Gene Name: protein phosphatase 2A activator, regulatory subunit 4
  Uniprot ID: Q15257
  ENSP ID: ENSP00000337448
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68814 - protein, 281 aa, Homo sapiens
  Payload ID: 13689
  Gene Symbol: PPP2R4
  Gene Name: protein phosphatase 2A activator, regulatory subunit 4
  Uniprot ID: Q15257
  ENSP ID: ENSP00000347109
MAEGERQPPPDSSEEAPPATQNFIIPKKEIHTVPDMGKWKRSQAYADYIGFILTLNEGVKGKKLTFEYRVSEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68815 - protein, 294 aa, Homo sapiens
  Payload ID: 13689
  Gene Symbol: PPP2R4
  Gene Name: protein phosphatase 2A activator, regulatory subunit 4
  Uniprot ID: Q15257
  ENSP ID: ENSP00000349726
MAEGERQPPPDSSEEAPPATQNFIIPKKEIHTVPDMGKWKRSQAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68816 - protein, 323 aa, Homo sapiens
  Payload ID: 13689
  Gene Symbol: PPP2R4
  Gene Name: protein phosphatase 2A activator, regulatory subunit 4
  Uniprot ID: Q15257
  ENSP ID: ENSP00000351885
MAEGERQPPPDSSEEAPPATQNFIIPKKEIHTVPDMGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68817 - protein, 323 aa, Homo sapiens; identical to SEQ ID NO: 68816
  Payload ID: 13689
  Gene Symbol: PPP2R4
  Gene Name: protein phosphatase 2A activator, regulatory subunit 4
  Uniprot ID: Q15257
  ENSP ID: ENSP00000377036

SEQ ID NO: 68818 - protein, 61 aa, Homo sapiens
  Payload ID: 13689
  Gene Symbol: PPP2R4
  Gene Name: protein phosphatase 2A activator, regulatory subunit 4
  ENSP ID: ENSP00000387726
MKTGPFAEHSNQLWNISAVPSWSKVNQGLIRMYKAECLEKFPVIQHFKFGSLLPIHPVTSG

SEQ ID NO: 68819 - protein, 41 aa, Homo sapiens
  Payload ID: 13689
  Gene Symbol: PPP2R4
  Gene Name: protein phosphatase 2A activator, regulatory subunit 4
  ENSP ID: ENSP00000389312
MKTGPFAEHSNQLWNISAVPSWSKVNQGLIRMYKAEAGPCD

SEQ ID NO: 68820 - protein, 129 aa, Homo sapiens
  Payload ID: 13689
  Gene Symbol: PPP2R4
  Gene Name: protein phosphatase 2A activator, regulatory subunit 4
  ENSP ID: ENSP00000393092
MGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLC

SEQ ID NO: 68821 - protein, 151 aa, Homo sapiens
  Payload ID: 13689
  Gene Symbol: PPP2R4
  Gene Name: protein phosphatase 2A activator, regulatory subunit 4
  ENSP ID: ENSP00000393196
MKTGPFAEHSNQLWNISAVPSWSKVNQGLIRMYKAEVSGGWPVCPSLLPHLVLGWGQSKRCGTWGSCFLLPHCFALNLRPAPLTLGASESPIWGMGSQRSTSHPSPEKLQSSSVLMSLEAEARTCCMGSGGDGGLPSPLSSGQRLLKARAV

SEQ ID NO: 68822 - protein, 64 aa, Homo sapiens
  Payload ID: 13689
  Gene Symbol: PPP2R4
  Gene Name: protein phosphatase 2A activator, regulatory subunit 4
  ENSP ID: ENSP00000393796
MGKWKRSQAYADYIGFILTLNEGVKGKKLTFEYRVSEAIEKLVALLNTLDRWIDETPPVDQPSR

SEQ ID NO: 68823 - protein, 61 aa, Homo sapiens; identical to SEQ ID NO: 68818
  Payload ID: 13689
  Gene Symbol: PPP2R4
  Gene Name: protein phosphatase 2A activator, regulatory subunit 4
  ENSP ID: ENSP00000394001

SEQ ID NO: 68824 - protein, 288 aa, Homo sapiens
  Payload ID: 13689
  Gene Symbol: PPP2R4
  Gene Name: protein phosphatase 2A activator, regulatory subunit 4
  ENSP ID: ENSP00000394338
MGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 68825 - protein, 250 aa, Homo sapiens
  Payload ID: 13689
  Gene Symbol: PPP2R4
  Gene Name: protein phosphatase 2A activator, regulatory subunit 4
  ENSP ID: ENSP00000395499
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDF

SEQ ID NO: 68826 - protein, 120 aa, Homo sapiens
  Payload ID: 13689
  Gene Symbol: PPP2R4
  Gene Name: protein phosphatase 2A activator, regulatory subunit 4
  ENSP ID: ENSP00000396660
  MOD_RES (1)..(1): Any amino acid
XYLEVMRKLQKTYRMEPAGSQGVWGLDDFQFLPFIWGSSQLIDHPYLEPRHFVDEKAVNENHKDYMFLECILFITEVRRRGEREAHGCLQAQMNQGWWPYSGSEEPELLPKMAGPAGAGY

SEQ ID NO: 68827 - protein, 132 aa, Homo sapiens
  Payload ID: 13689
  Gene Symbol: PPP2R4
  Gene Name: protein phosphatase 2A activator, regulatory subunit 4
  ENSP ID: ENSP00000399069
MWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKI

SEQ ID NO: 68828 - protein, 176 aa, Homo sapiens
  Payload ID: 13689
  Gene Symbol: PPP2R4
  Gene Name: protein phosphatase 2A activator, regulatory subunit 4
  ENSP ID: ENSP00000400314
MISAHCNPHLLDSGDPPASASQVAGTTDSSEEAPPATQNFIIPKKEIHTVPDMGKWKRSQVPFGTVAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGT

SEQ ID NO: 68829 - protein, 263 aa, Homo sapiens
  Payload ID: 13689
  Gene Symbol: PPP2R4
  Gene Name: protein phosphatase 2A activator, regulatory subunit 4
  ENSP ID: ENSP00000403542
MGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAE

SEQ ID NO: 68830 - protein, 218 aa, Homo sapiens
  Payload ID: 13689
  Gene Symbol: PPP2R4
  Gene Name: protein phosphatase 2A activator, regulatory subunit 4
  ENSP ID: ENSP00000405100
  MOD_RES (1)..(1): Any amino acid
XKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAEVSGGWPVCPSLLPHLVLGWGQSKRCGTWGSCFLLPHCFALNLRPAPLTLGASESPIWGMGSQRSTSHPSPEKLQSSSVLMSLEAEARTCCMGSGGDGGLPSPLSSGQRLLKARAV

SEQ ID NO: 68831 - protein, 253 aa, Homo sapiens
  Payload ID: 13689
  Gene Symbol: PPP2R4
  Gene Name: protein phosphatase 2A activator, regulatory subunit 4
  ENSP ID: ENSP00000406997
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFL

SEQ ID NO: 68832 - protein, 61 aa, Homo sapiens; identical to SEQ ID NO: 68818
  Payload ID: 13689
  Gene Symbol: PPP2R4
  Gene Name: protein phosphatase 2A activator, regulatory subunit 4
  ENSP ID: ENSP00000408316

SEQ ID NO: 68833 - protein, 61 aa, Homo sapiens; identical to SEQ ID NO: 68818
  Payload ID: 13689
  Gene Symbol: PPP2R4
  Gene Name: protein phosphatase 2A activator, regulatory subunit 4
  ENSP ID: ENSP00000408726

SEQ ID NO: 68834 - protein, 61 aa, Homo sapiens; identical to SEQ ID NO: 68818
  Payload ID: 13689
  Gene Symbol: PPP2R4
  Gene Name: protein phosphatase 2A activator, regulatory subunit 4
  ENSP ID: ENSP00000411604

SEQ ID NO: 68835 - protein, 77 aa, Homo sapiens
  Payload ID: 13689
  Gene Symbol: PPP2R4
  Gene Name: protein phosphatase 2A activator, regulatory subunit 4
  ENSP ID: ENSP00000416522
MKTGPFAEHSNQLWNISAVPSWSKVNQGLIRMYKAEASPSDTWGLGISHLGHGQSEKHQPPQPRKAAVQLCPDELGG

SEQ ID NO: 68836 - protein, 61 aa, Homo sapiens; identical to SEQ ID NO: 68818
  Payload ID: 13689
  Gene Symbol: PPP2R4
  Gene Name: protein phosphatase 2A activator, regulatory subunit 4
  ENSP ID: ENSP00000416661

SEQ ID NO: 68837 - protein, 376 aa, Homo sapiens
  Payload ID: 13690
  Gene Symbol: PP2D1
  Gene Name: protein phosphatase 2C-like domain containing 1
  Uniprot ID: A8MPX8
  ENSP ID: ENSP00000331295
MSTNNALRVFWKSREWNMKTSTFDSDEDILLLPKRKRFRKKKSRPVRHTKRHEEEQVYEQGTTLPCSICKHEIDLTGIFLHKKQHVALATLGFQWMGRKKPQPSVIAVQRQFMISKLLSSFMFTEKTLQSINNAFELLWKKQIPAYYKIFDNIDRSVIYSQKICHLLIKGVGICEDRNSTWKADMNDKFTVVSNFGNKPNVCFFGLFDGHHGASAAELTSMELPVLLLHQLSKFDPSYQMTTDEQQIINSFYTVFREEYAAIEDLFSAINKTEAVRCEYEDTHKAFAKAFWRMDRLLGLGRKEVSRVQWSGCSAVTCILEGKPKSPYAHKNWKRKNTHDGLAESSPSQEMPKIISGILHVANTGTRRNEHLPEYYG

SEQ ID NO: 68838 - protein, 630 aa, Homo sapiens
  Payload ID: 13690
  Gene Symbol: PP2D1
  Gene Name: protein phosphatase 2C-like domain containing 1
  Uniprot ID: A8MPX8
  ENSP ID: ENSP00000373702
MSTNNALRVFWKSREWNMKTSTFDSDEDILLLPKRKRFRKKKSRPVRHTKRHEEEQVYEQGTTLPCSICKHEIDLTGIFLHKKQHVALATLGFQWMGRKKPQPSVIAVQRQFMISKLLSSFMFTEKTLQSINNAFELLWKKQIPAYYKIFDNIDRSVIYSQKICHLLIKGVGICEDRNSTWKADMNDKFTVVSNFGNKPNVCFFGLFDGHHGASAAELTSMELPVLLLHQLSKFDPSYQMTTDEQQIINSFYTVFREEYAAIEDLFSAINKTEAVRCEYEDTHKAFAKAFWRMDRLLGLGRKEVSRVQWSGCSAVTCILEGKPKSPYAHKNWKRKNTHDGLAESSPSQEMPKIISGILHVANTGNVQAVLCRNGKGFCLTKEHTTRNTNERRRILQNGAVISSNEPYGLVEGQVKTTRGLGFHGNLKLKKSIIPAPQTISVPIDDLCQFLIVATNGLWEVLDKEEVTALAMTTFHMYKETYCPIIPNKSPSKGPLLFSTSEPNLTKSQSNIHVLFQYKSVSEVRVSTTNSKENLSDSNYSKYCIYNPENVETFPAETTHRKPCSEKVTDRPTSVNDVATNEKESDTKSFYEGAAEYVSHELVNAALLAGSRDNITVMVIFLNGSEYQLLT

SEQ ID NO: 68839 - protein, 469 aa, Homo sapiens
  Payload ID: 13691
  Gene Symbol: PPP3CA
  Gene Name: protein phosphatase 3, catalytic subunit, alpha isozyme
  Uniprot ID: Q08209
  ENSP ID: ENSP00000320580
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 68840 - protein, 511 aa, Homo sapiens
  Payload ID: 13691
  Gene Symbol: PPP3CA
  Gene Name: protein phosphatase 3, catalytic subunit, alpha isozyme
  Uniprot ID: Q08209
  ENSP ID: ENSP00000378322
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 68841 - protein, 521 aa, Homo sapiens
  Payload ID: 13691
  Gene Symbol: PPP3CA
  Gene Name: protein phosphatase 3, catalytic subunit, alpha isozyme
  Uniprot ID: Q08209
  ENSP ID: ENSP00000378323
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 68842 - protein, 289 aa, Homo sapiens
  Payload ID: 13691
  Gene Symbol: PPP3CA
  Gene Name: protein phosphatase 3, catalytic subunit, alpha isozyme
  Uniprot ID: Q08209
  ENSP ID: ENSP00000422781
MSEPKAIDPKLSTTDRVVKAVPFPPSHRLTAKEVFDNDGKPRVDILKAHLMKEGRLEESVALRIITEGASILRQEKNLLDIDAPVTAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 68843 - protein, 423 aa, Homo sapiens
  Payload ID: 13691
  Gene Symbol: PPP3CA
  Gene Name: protein phosphatase 3, catalytic subunit, alpha isozyme
  ENSP ID: ENSP00000422990
MKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 68844 - protein, 16 aa, Homo sapiens
  Payload ID: 13691
  Gene Symbol: PPP3CA
  Gene Name: protein phosphatase 3, catalytic subunit, alpha isozyme
  ENSP ID: ENSP00000426565
APVTEAPQMTPIHTPR

SEQ ID NO: 68845 - protein, 147 aa, Homo sapiens
  Payload ID: 13691
  Gene Symbol: PPP3CA
  Gene Name: protein phosphatase 3, catalytic subunit, alpha isozyme
  ENSP ID: ENSP00000431619
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLC

SEQ ID NO: 68846 - protein, 132 aa, Homo sapiens
  Payload ID: 13691
  Gene Symbol: PPP3CA
  Gene Name: protein phosphatase 3, catalytic subunit, alpha isozyme
  ENSP ID: ENSP00000434599
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAF

SEQ ID NO: 68847 - protein, 496 aa, Homo sapiens
  Payload ID: 13692
  Gene Symbol: PPP3CB
  Gene Name: protein phosphatase 3, catalytic subunit, beta isozyme
  ENSP ID: ENSP00000343147
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSGNDVMQLAVPQMDWGTPHSFANNSHNACREFLLFFSSCLSS

SEQ ID NO: 68848 - protein, 524 aa, Homo sapiens
  Payload ID: 13692
  Gene Symbol: PPP3CB
  Gene Name: protein phosphatase 3, catalytic subunit, beta isozyme
  Uniprot ID: P16298
  ENSP ID: ENSP00000353881
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 68849 - protein, 515 aa, Homo sapiens
  Payload ID: 13692
  Gene Symbol: PPP3CB
  Gene Name: protein phosphatase 3, catalytic subunit, beta isozyme
  Uniprot ID: P16298
  ENSP ID: ENSP00000378305
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSAIRGFSPPHRICSFEEAKGLDRINERMPPRKDAVQQDGFNSLNTAHATENHGTGNHTAQ

SEQ ID NO: 68850 - protein, 525 aa, Homo sapiens
  Payload ID: 13692
  Gene Symbol: PPP3CB
  Gene Name: protein phosphatase 3, catalytic subunit, beta isozyme
  Uniprot ID: P16298
  ENSP ID: ENSP00000378306
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 68851 - protein, 187 aa, Homo sapiens
  Payload ID: 13692
  Gene Symbol: PPP3CB
  Gene Name: protein phosphatase 3, catalytic subunit, beta isozyme
  ENSP ID: ENSP00000398022
HPYWLPNFMDVFTWSLPFVGEKVTEMLVNVLSICSDDELMTEGEDQFDERLIYGNKKVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 68852 - protein, 512 aa, Homo sapiens
  Payload ID: 13693
  Gene Symbol: PPP3CC
  Gene Name: protein phosphatase 3, catalytic subunit, gamma isozyme
  Uniprot ID: P48454
  ENSP ID: ENSP00000240139
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 68853 - protein, 502 aa, Homo sapiens
  Payload ID: 13693
  Gene Symbol: PPP3CC
  Gene Name: protein phosphatase 3, catalytic subunit, gamma isozyme
  Uniprot ID: P48454
  ENSP ID: ENSP00000289963
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETAIRGFSLQHKIRSFEEARGLDRINERMPPRKDSIHAGGPMKSVTSAHSHAAHRSDQGKKAHS

SEQ ID NO: 68854 - protein, 521 aa, Homo sapiens
  Payload ID: 13693
  Gene Symbol: PPP3CC
  Gene Name: protein phosphatase 3, catalytic subunit, gamma isozyme
  Uniprot ID: P48454
  ENSP ID: ENSP00000380878
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEDHYIPSYQKGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 68855 - protein, 153 aa, Homo sapiens
  Payload ID: 13693
  Gene Symbol: PPP3CC
  Gene Name: protein phosphatase 3, catalytic subunit, gamma isozyme
  ENSP ID: ENSP00000428358
ARPAGSWSLEEAEGTMSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIEVKIKLDMLGLLYCL

SEQ ID NO: 68856 - protein, 202 aa, Homo sapiens
  Payload ID: 13693
  Gene Symbol: PPP3CC
  Gene Name: protein phosphatase 3, catalytic subunit, gamma isozyme
  ENSP ID: ENSP00000428390
  MOD_RES (1)..(1): Any amino acid
XCVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKESATHSFDYPQ

SEQ ID NO: 68857 - protein, 326 aa, Homo sapiens
  Payload ID: 13693
  Gene Symbol: PPP3CC
  Gene Name: protein phosphatase 3, catalytic subunit, gamma isozyme
  ENSP ID: ENSP00000429379
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKGKGIQQYLSLNL

SEQ ID NO: 68858 - protein, 134 aa, Homo sapiens
  Payload ID: 13693
  Gene Symbol: PPP3CC
  Gene Name: protein phosphatase 3, catalytic subunit, gamma isozyme
  ENSP ID: ENSP00000430555
METFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYL

SEQ ID NO: 68859 - protein, 209 aa, Homo sapiens
  Payload ID: 13693
  Gene Symbol: PPP3CC
  Gene Name: protein phosphatase 3, catalytic subunit, gamma isozyme
  ENSP ID: ENSP00000430783
  MOD_RES (1)..(1): Any amino acid
XLCGQRLFQYRGRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKGKR

SEQ ID NO: 68860 - protein, 170 aa, Homo sapiens
  Payload ID: 13694
  Gene Symbol: PPP3R1
  Gene Name: protein phosphatase 3, regulatory subunit B, alpha
  Uniprot ID: P63098
  ENSP ID: ENSP00000234310
MGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCAVVGGLDIHKKMVVDV

SEQ ID NO: 68861 - protein, 160 aa, Homo sapiens
  Payload ID: 13694
  Gene Symbol: PPP3R1
  Gene Name: protein phosphatase 3, regulatory subunit B, alpha
  ENSP ID: ENSP00000387148
MCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCAVVGGLDIHKKMVVDV

SEQ ID NO: 68862 - protein, 189 aa, Homo sapiens
  Payload ID: 13694
  Gene Symbol: PPP3R1
  Gene Name: protein phosphatase 3, regulatory subunit B, alpha
  ENSP ID: ENSP00000387216
MQPQCPLRRESCGMELCGKKGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCAVVGGLDIHKKMVVDV

SEQ ID NO: 68863 - protein, 173 aa, Homo sapiens
  Payload ID: 13695
  Gene Symbol: PPP3R2
  Gene Name: protein phosphatase 3, regulatory subunit B, beta
  Uniprot ID: Q96LZ3
  ENSP ID: ENSP00000363939
MSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 68864 - protein, 307 aa, Homo sapiens
  Payload ID: 13696
  Gene Symbol: PPP4C
  Gene Name: protein phosphatase 4, catalytic subunit
  Uniprot ID: P60510
  ENSP ID: ENSP00000279387
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 68865 - protein, 50 aa, Homo sapiens
  Payload ID: 13696
  Gene Symbol: PPP4C
  Gene Name: protein phosphatase 4, catalytic subunit
  ENSP ID: ENSP00000455394
MAEISDLDRQIEQLRRCELIKESEVKALCAKARCAATSMDNSMTSKSCSE

SEQ ID NO: 68866 - protein, 307 aa, Homo sapiens; identical to SEQ ID NO: 68864
  Payload ID: 13696
  Gene Symbol: PPP4C
  Gene Name: protein phosphatase 4, catalytic subunit
  Uniprot ID: P60510
  ENSP ID: ENSP00000455995

SEQ ID NO: 68867 - protein, 267 aa, Homo sapiens
  Payload ID: 13696
  Gene Symbol: PPP4C
  Gene Name: protein phosphatase 4, catalytic subunit
  ENSP ID: ENSP00000457089
MAEISDLDRQIEQLRRCELIKESEVKALCAKAREILVEESNVQRVDSPVTVCGDIHGQFYDLKELFRVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKP

SEQ ID NO: 68868 - protein, 203 aa, Homo sapiens
  Payload ID: 13696
  Gene Symbol: PPP4C
  Gene Name: protein phosphatase 4, catalytic subunit
  ENSP ID: ENSP00000457915
MAEISDLDRQIEQLRRCELIKESEVKALCAKAREILVEESNVQRVDSPVTVCGDIHGQFYDLKELFRVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRA

SEQ ID NO: 68869 - protein, 56 aa, Homo sapiens
  Payload ID: 13696
  Gene Symbol: PPP4C
  Gene Name: protein phosphatase 4, catalytic subunit
  ENSP ID: ENSP00000458079
MAEISDLDRQIEQLRRCELIKESEVKALCAKARSGIGLGWPGCGDPGLLLSPERSW

SEQ ID NO: 68870 - protein, 120 aa, Homo sapiens
  Payload ID: 13696
  Gene Symbol: PPP4C
  Gene Name: protein phosphatase 4, catalytic subunit
  ENSP ID: ENSP00000461609
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVAVPGFCTPNLGDLGPGLS

SEQ ID NO: 68871 - protein, 50 aa, Homo sapiens; identical to SEQ ID NO: 68865
  Payload ID: 13696
  Gene Symbol: PPP4C
  Gene Name: protein phosphatase 4, catalytic subunit
  ENSP ID: ENSP00000486140

SEQ ID NO: 68872 - protein, 84 aa, Homo sapiens
  Payload ID: 13697
  Gene Symbol: PPP4R1
  Gene Name: protein phosphatase 4, regulatory subunit 1
  ENSP ID: ENSP00000285124
MADLSLLQEDLQEDADGSLDFVSQDEMLTPLGRLDKYAASENIFNRTNCESGADGTGASHRTVLSRKPAFNTICFFKILTTYCG

SEQ ID NO: 68873 - protein, 933 aa, Homo sapiens
  Payload ID: 13697
  Gene Symbol: PPP4R1
  Gene Name: protein phosphatase 4, regulatory subunit 1
  Uniprot ID: Q8TF05
  ENSP ID: ENSP00000383401
MADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 68874 - protein, 950 aa, Homo sapiens
  Payload ID: 13697
  Gene Symbol: PPP4R1
  Gene Name: protein phosphatase 4, regulatory subunit 1
  Uniprot ID: Q8TF05
  ENSP ID: ENSP00000383402
MADLSLLQEDLQEDADGFGVDDYSSESDVIIIPSALDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 68875 - protein, 97 aa, Homo sapiens
  Payload ID: 13697
  Gene Symbol: PPP4R1
  Gene Name: protein phosphatase 4, regulatory subunit 1
  ENSP ID: ENSP00000462161
MLTPLGRLDKYAASENIFNRQMVARSLLDTLREVCDDERDCIAVLERISRLADDSEPTVRAELMEQVPHIALFCQENRPSIPYAFSKFLLPIVVRYL

SEQ ID NO: 68876 - protein, 143 aa, Homo sapiens
  Payload ID: 13697
  Gene Symbol: PPP4R1
  Gene Name: protein phosphatase 4, regulatory subunit 1
  ENSP ID: ENSP00000462399
MLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSN

SEQ ID NO: 68877 - protein, 17 aa, Homo sapiens
  Payload ID: 13697
  Gene Symbol: PPP4R1
  Gene Name: protein phosphatase 4, regulatory subunit 1
  ENSP ID: ENSP00000462485
MADLSLLQEDLQEDADG

SEQ ID NO: 68878 - protein, 101 aa, Homo sapiens
  Payload ID: 13697
  Gene Symbol: PPP4R1
  Gene Name: protein phosphatase 4, regulatory subunit 1
  ENSP ID: ENSP00000462621
MADLSLLQEDLQEDADGFGVDDYSSESDVIIIPSALDFVSQDEMLTPLGRLDKYAASENIFNRTNCESGADGTGASHRTVLSRKPAFNTICFFKILTTYCG

SEQ ID NO: 68879 - protein, 135 aa, Homo sapiens
  Payload ID: 13697
  Gene Symbol: PPP4R1
  Gene Name: protein phosphatase 4, regulatory subunit 1
  ENSP ID: ENSP00000463345
MLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLI

SEQ ID NO: 68880 - protein, 151 aa, Homo sapiens
  Payload ID: 13697
  Gene Symbol: PPP4R1
  Gene Name: protein phosphatase 4, regulatory subunit 1
  ENSP ID: ENSP00000463459
MLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAV

SEQ ID NO: 68881 - protein, 190 aa, Homo sapiens
  Payload ID: 13697
  Gene Symbol: PPP4R1
  Gene Name: protein phosphatase 4, regulatory subunit 1
  ENSP ID: ENSP00000463909
MTLSVNHPAAGPWALLAATWRGPRAGGEAALPPRGGGTPAPTTSEPPPAPDRRRHLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAAL

SEQ ID NO: 68882 - protein, 75 aa, Homo sapiens
  Payload ID: 13697
  Gene Symbol: PPP4R1
  Gene Name: protein phosphatase 4, regulatory subunit 1
  ENSP ID: ENSP00000464394
MADLSLLQEDLQEDADGSLDFVSQDEMLTPLGRLDKYAASENIFNRYRPGAVTHACNPSTLGGQDKWWPGVCSIP

SEQ ID NO: 68883 - protein, 417 aa, Homo sapiens
  Payload ID: 13698
  Gene Symbol: PPP4R2
  Gene Name: protein phosphatase 4, regulatory subunit 2
  Uniprot ID: Q9NY27
  ENSP ID: ENSP00000349124
MDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 68884 - protein, 116 aa, Homo sapiens
  Payload ID: 13698
  Gene Symbol: PPP4R2
  Gene Name: protein phosphatase 4, regulatory subunit 2
  ENSP ID: ENSP00000418568
MDVERLQEALKDFEKRGKKEVCPVLDQFLCHVAKTGETIIPFTIQRLCELLTDPRRNYTGTDKFLRGVEKNVMVVSCVYPSSEKNNSNSLNRMNGVMFPGNSPSYTESPHDNKWVA

SEQ ID NO: 68885 - protein, 69 aa, Homo sapiens
  Payload ID: 13698
  Gene Symbol: PPP4R2
  Gene Name: protein phosphatase 4, regulatory subunit 2
  ENSP ID: ENSP00000418675
MDVERLQEALKDFEKRGKKEVCPVLDQFLCHVAKTGETMLASKPWPQVIHLPQLPKLRGLQIRDGVSPC

SEQ ID NO: 68886 - protein, 226 aa, Homo sapiens
  Payload ID: 13698
  Gene Symbol: PPP4R2
  Gene Name: protein phosphatase 4, regulatory subunit 2
  ENSP ID: ENSP00000418750
MDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSESNINGPGTPRPLNRPKVSLSAPMTTNGLPESTDSKEANLQQNEEKNHSDSSTSESEVSSVSPLKNKHPDEDAVEAEGHEVKRLRFD

SEQ ID NO: 68887 - protein, 143 aa, Homo sapiens
  Payload ID: 13698
  Gene Symbol: PPP4R2
  Gene Name: protein phosphatase 4, regulatory subunit 2
  ENSP ID: ENSP00000419055
  MOD_RES (1)..(1): Any amino acid
XGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEGI

SEQ ID NO: 68888 - protein, 62 aa, Homo sapiens
  Payload ID: 13698
  Gene Symbol: PPP4R2
  Gene Name: protein phosphatase 4, regulatory subunit 2
  ENSP ID: ENSP00000420098
MIQWSQFKGYFIFKLEKVMDDFRTSAPEPRGPPNPNVEYIPFDEMKERILKIVTGFNGIPFT

SEQ ID NO: 68889 - protein, 150 aa, Homo sapiens
  Payload ID: 13699
  Gene Symbol: PPP4R3A
  Gene Name: protein phosphatase 4, regulatory subunit 3A
  ENSP ID: ENSP00000450432
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASS

SEQ ID NO: 68890 - protein, 543 aa, Homo sapiens
  Payload ID: 13699
  Gene Symbol: PPP4R3A
  Gene Name: protein phosphatase 4, regulatory subunit 3A
  ENSP ID: ENSP00000450473
  MOD_RES (1)..(1): Any amino acid
XGTMTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLAL

SEQ ID NO: 68891 - protein, 820 aa, Homo sapiens
  Payload ID: 13699
  Gene Symbol: PPP4R3A
  Gene Name: protein phosphatase 4, regulatory subunit 3A
  Uniprot ID: Q6IN85
  ENSP ID: ENSP00000450864
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 68892 - protein, 833 aa, Homo sapiens
  Payload ID: 13699
  Gene Symbol: PPP4R3A
  Gene Name: protein phosphatase 4, regulatory subunit 3A
  Uniprot ID: Q6IN85
  ENSP ID: ENSP00000450883
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 68893 - protein, 594 aa, Homo sapiens
  Payload ID: 13699
  Gene Symbol: PPP4R3A
  Gene Name: protein phosphatase 4, regulatory subunit 3A
  Uniprot ID: Q6IN85
  ENSP ID: ENSP00000450891
MTDTRRRVKVYTLNEDRQWDDRGTGHVSSGYVERLKGMSLLVRAESDGSLLLESKINPNTAYQKQQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 68894 - protein, 199 aa, Homo sapiens
  Payload ID: 13699
  Gene Symbol: PPP4R3A
  Gene Name: protein phosphatase 4, regulatory subunit 3A
  ENSP ID: ENSP00000451841
  MOD_RES (1)..(1): Any amino acid
XLFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELPQNRDAFFKTLSNMGILPALEVILGMDDTQVRSAATDIFSYLVEYNPSMVREFVMQEAQQNDDVSKKLTEQKI

SEQ ID NO: 68895 - protein, 99 aa, Homo sapiens
  Payload ID: 13699
  Gene Symbol: PPP4R3A
  Gene Name: protein phosphatase 4, regulatory subunit 3A
  ENSP ID: ENSP00000451939
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQ

SEQ ID NO: 68896 - protein, 190 aa, Homo sapiens
  Payload ID: 13699
  Gene Symbol: PPP4R3A
  Gene Name: protein phosphatase 4, regulatory subunit 3A
  ENSP ID: ENSP00000452257
MTDTRRRVKVYTLNEDRQWDDRGTGHVSSGYVERLKGMSLLVRAESDGSLLLESKINPNTAYQKQQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINL

SEQ ID NO: 68897 - protein, 706 aa, Homo sapiens
  Payload ID: 13699
  Gene Symbol: PPP4R3A
  Gene Name: protein phosphatase 4, regulatory subunit 3A
  ENSP ID: ENSP00000452596
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMER

SEQ ID NO: 68898 - protein, 764 aa, Homo sapiens
  Payload ID: 13700
  Gene Symbol: PPP4R3B
  Gene Name: protein phosphatase 4, regulatory subunit 3B
  Uniprot ID: Q5MIZ7
  ENSP ID: ENSP00000478677
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPGALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 68899 - protein, 849 aa, Homo sapiens
  Payload ID: 13700
  Gene Symbol: PPP4R3B
  Gene Name: protein phosphatase 4, regulatory subunit 3B
  Uniprot ID: Q5MIZ7
  ENSP ID: ENSP00000483228
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFICTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 68900 - protein, 817 aa, Homo sapiens
  Payload ID: 13700
  Gene Symbol: PPP4R3B
  Gene Name: protein phosphatase 4, regulatory subunit 3B
  Uniprot ID: Q5MIZ7
  ENSP ID: ENSP00000484116
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 68901 - protein, 873 aa, Homo sapiens
  Payload ID: 13701
  Gene Symbol: PPP4R4
  Gene Name: protein phosphatase 4, regulatory subunit 4
  Uniprot ID: Q6NUP7
  ENSP ID: ENSP00000305924
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPAMIVFVDPKNFHMELYSTFFCLCHDPEVPVRYTIAICFYEVSKLLNSGVYLIHKELITLLQDESLEVLDALIDHLPEILELMSTGGESSVQENKLSSLPDLIPALTAAEQRAAASLKWRTHEKLLQKYACLPHVISSDQIYYRFLQRMFTIMMTNNVLPVQKAASRTLCIFLRYNRKQEQRHEVIQKLIEQLGQGKSYWNRLRFLDTCEFIIEIFSKSFFCKYFFLPAIELTHDPVANVRMKLCYLLPKVKSTLKIPADKHLLQQLEMCVRKLLCQEKDKDVLAIVKRTVLELDRMEMSMDAFQKKFYEKDLLDQEKEREELLLLEMEQLEKEKQQNDGRPMSDKMFEKKRRDTKTPTQSLPKNIPISVPGPSSVTPSTSKEIKKSKLIRSQSFNNQAFHAKYGNLEKCASKSSTTGYTTSVSGLGKTSVLSLADDSFRTRNASSVPSSFSPNTPLPSTSRGTGNSVDPKSSGSKDTQPRKATLKSRKSNP

SEQ ID NO: 68902 - protein, 120 aa, Homo sapiens
  Payload ID: 13701
  Gene Symbol: PPP4R4
  Gene Name: protein phosphatase 4, regulatory subunit 4
  Uniprot ID: Q6NUP7
  ENSP ID: ENSP00000330831
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRVHEDAHLFIQRVWISHMFVQRV

SEQ ID NO: 68903 - protein, 57 aa, Homo sapiens
  Payload ID: 13701
  Gene Symbol: PPP4R4
  Gene Name: protein phosphatase 4, regulatory subunit 4
  ENSP ID: ENSP00000451543
MRQNPTETLRRVLPKVREALHVAGVEMQLTAAMSFLTILQDESVSIHAYTHSFLQVI

SEQ ID NO: 68904 - protein, 113 aa, Homo sapiens
  Payload ID: 13701
  Gene Symbol: PPP4R4
  Gene Name: protein phosphatase 4, regulatory subunit 4
  ENSP ID: ENSP00000451556
MRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSC

SEQ ID NO: 68905 - protein, 62 aa, Homo sapiens
  Payload ID: 13701
  Gene Symbol: PPP4R4
  Gene Name: protein phosphatase 4, regulatory subunit 4
  ENSP ID: ENSP00000452121
MRQNPTETLRRVLPKVRCLPRSMRMHTYLSREYGSHICLSRGCDSVEENTYWKPCMLQEWKC

SEQ ID NO: 68906 - protein, 873 aa, Homo sapiens; identical to SEQ ID NO: 68901
  Payload ID: 13701
  Gene Symbol: PPP4R4
  Gene Name: protein phosphatase 4, regulatory subunit 4
  Uniprot ID: Q6NUP7
  ENSP ID: ENSP00000480902

SEQ ID NO: 68907 - protein, 120 aa, Homo sapiens; identical to SEQ ID NO: 68902
  Payload ID: 13701
  Gene Symbol: PPP4R4
  Gene Name: protein phosphatase 4, regulatory subunit 4
  Uniprot ID: Q6NUP7
  ENSP ID: ENSP00000482849

SEQ ID NO: 68908 - protein, 113 aa, Homo sapiens; identical to SEQ ID NO: 68904
  Payload ID: 13701
  Gene Symbol: PPP4R4
  Gene Name: protein phosphatase 4, regulatory subunit 4
  ENSP ID: ENSP00000486247

SEQ ID NO: 68909 - protein, 62 aa, Homo sapiens; identical to SEQ ID NO: 68905
  Payload ID: 13701
  Gene Symbol: PPP4R4
  Gene Name: protein phosphatase 4, regulatory subunit 4
  ENSP ID: ENSP00000487248

SEQ ID NO: 68910 - protein, 57 aa, Homo sapiens; identical to SEQ ID NO: 68903
  Payload ID: 13701
  Gene Symbol: PPP4R4
  Gene Name: protein phosphatase 4, regulatory subunit 4
  ENSP ID: ENSP00000487271

SEQ ID NO: 68911 - protein, 499 aa, Homo sapiens
  Payload ID: 13702
  Gene Symbol: PPP5C
  Gene Name: protein phosphatase 5, catalytic subunit
  Uniprot ID: P53041
  ENSP ID: ENSP00000012443
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 68912 - protein, 371 aa, Homo sapiens
  Payload ID: 13702
  Gene Symbol: PPP5C
  Gene Name: protein phosphatase 5, catalytic subunit
  ENSP ID: ENSP00000375786
MALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQTEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 68913 - protein, 485 aa, Homo sapiens
  Payload ID: 13702
  Gene Symbol: PPP5C
  Gene Name: protein phosphatase 5, catalytic subunit
  ENSP ID: ENSP00000434329
  MOD_RES (1)..(1): Any amino acid
XMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVGRPSSGS

SEQ ID NO: 68914 - protein, 305 aa, Homo sapiens
  Payload ID: 13703
  Gene Symbol: PPP6C
  Gene Name: protein phosphatase 6, catalytic subunit
  Uniprot ID: O00743
  ENSP ID: ENSP00000362648
MAPLDLDKYVEIARLCKYLPENDLKRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 68915 - protein, 342 aa, Homo sapiens
  Payload ID: 13703
  Gene Symbol: PPP6C
  Gene Name: protein phosphatase 6, catalytic subunit
  Uniprot ID: O00743
  ENSP ID: ENSP00000392147
MAPLDLDKYVEIARLCKYLPENDLKVSPICGLAPSGCGAPAGRPFLSPGPPPVFHFLRFLKERLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 68916 - protein, 283 aa, Homo sapiens
  Payload ID: 13703
  Gene Symbol: PPP6C
  Gene Name: protein phosphatase 6, catalytic subunit
  Uniprot ID: O00743
  ENSP ID: ENSP00000411744
MAPLDLDKYVEIARLCKYLPENDLKRLCDYVCDLLLEESNVQPVSTPVTVCGDIHGQGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 68917 - protein, 125 aa, Homo sapiens
  Payload ID: 13703
  Gene Symbol: PPP6C
  Gene Name: protein phosphatase 6, catalytic subunit
  ENSP ID: ENSP00000416287
MFLLPRLQLLGQMRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNAN

SEQ ID NO: 68918 - protein, 881 aa, Homo sapiens
  Payload ID: 13704
  Gene Symbol: PPP6R1
  Gene Name: protein phosphatase 6, regulatory subunit 1
  Uniprot ID: Q9UPN7
  ENSP ID: ENSP00000414202
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 68919 - protein, 157 aa, Homo sapiens
  Payload ID: 13704
  Gene Symbol: PPP6R1
  Gene Name: protein phosphatase 6, regulatory subunit 1
  ENSP ID: ENSP00000466332
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHI

SEQ ID NO: 68920 - protein, 881 aa, Homo sapiens; identical to SEQ ID NO: 68918
  Payload ID: 13704
  Gene Symbol: PPP6R1
  Gene Name: protein phosphatase 6, regulatory subunit 1
  Uniprot ID: Q9UPN7
  ENSP ID: ENSP00000467521

SEQ ID NO: 68921 - protein, 966 aa, Homo sapiens
  Payload ID: 13705
  Gene Symbol: PPP6R2
  Gene Name: protein phosphatase 6, regulatory subunit 2
  Uniprot ID: O75170
  ENSP ID: ENSP00000216061
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKASQASYFAVSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68922 - protein, 927 aa, Homo sapiens
  Payload ID: 13705
  Gene Symbol: PPP6R2
  Gene Name: protein phosphatase 6, regulatory subunit 2
  Uniprot ID: O75170
  ENSP ID: ENSP00000352051
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGQMPRQKELP

SEQ ID NO: 68923 - protein, 933 aa, Homo sapiens
  Payload ID: 13705
  Gene Symbol: PPP6R2
  Gene Name: protein phosphatase 6, regulatory subunit 2
  Uniprot ID: O75170
  ENSP ID: ENSP00000379090
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESRQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68924 - protein, 932 aa, Homo sapiens
  Payload ID: 13705
  Gene Symbol: PPP6R2
  Gene Name: protein phosphatase 6, regulatory subunit 2
  Uniprot ID: O75170
  ENSP ID: ENSP00000379093
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68925 - protein, 685 aa, Homo sapiens
  Payload ID: 13705
  Gene Symbol: PPP6R2
  Gene Name: protein phosphatase 6, regulatory subunit 2
  ENSP ID: ENSP00000384532
  MOD_RES (1)..(1): Any amino acid
XLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68926 - protein, 562 aa, Homo sapiens
  Payload ID: 13705
  Gene Symbol: PPP6R2
  Gene Name: protein phosphatase 6, regulatory subunit 2
  ENSP ID: ENSP00000391595
  MOD_RES (1)..(1): Any amino acid
XLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68927 - protein, 959 aa, Homo sapiens
  Payload ID: 13705
  Gene Symbol: PPP6R2
  Gene Name: protein phosphatase 6, regulatory subunit 2
  Uniprot ID: O75170
  ENSP ID: ENSP00000478417
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 68928 - protein, 793 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000265636
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68929 - protein, 827 aa, Homo sapiens
  Payload ID: 13706
  Gene Symbol: PPP6R3
  Gene Name: protein phosphatase 6, regulatory subunit 3
  ENSP ID: ENSP00000265637
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68930 - protein, 873 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000377389
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68931 - protein, 879 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000377390
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKRVLKSYREEGKLSTSQDAACKDAEECPETAEAKCAAPRPPSSSPEQRTGQPSAPGDTSVNGPV

SEQ ID NO: 68932 - protein, 844 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000431415
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68933 - protein, 140 aa, Homo sapiens
  Payload ID: 13706
  Gene Symbol: PPP6R3
  Gene Name: protein phosphatase 6, regulatory subunit 3
  ENSP ID: ENSP00000431738
MNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQN

SEQ ID NO: 68934 - protein, 186 aa, Homo sapiens
  Payload ID: 13706
  Gene Symbol: PPP6R3
  Gene Name: protein phosphatase 6, regulatory subunit 3
  ENSP ID: ENSP00000432837
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWL

SEQ ID NO: 68935 - protein, 867 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000433058
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68936 - protein, 75 aa, Homo sapiens
  Payload ID: 13706
  Gene Symbol: PPP6R3
  Gene Name: protein phosphatase 6, regulatory subunit 3
  ENSP ID: ENSP00000433551
MFWKFDLHSSSHIDTLLEREDVTLKELMDEEDVLQECKAQNRKLIEFLLKAECLEDLVSFIIEEPPQDMDEKIRY

SEQ ID NO: 68937 - protein, 838 aa, Homo sapiens
  Payload ID: 13706
  Gene Symbol: PPP6R3
  Gene Name: protein phosphatase 6, regulatory subunit 3
  ENSP ID: ENSP00000433565
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68938 - protein, 39 aa, Homo sapiens
  Payload ID: 13706
  Gene Symbol: PPP6R3
  Gene Name: protein phosphatase 6, regulatory subunit 3
  ENSP ID: ENSP00000433768
MFWKFDLHSSSHIDTLLEREDVTLKELMDEEDVLQECKA

SEQ ID NO: 68939 - protein, 51 aa, Homo sapiens
  Payload ID: 13706
  Gene Symbol: PPP6R3
  Gene Name: protein phosphatase 6, regulatory subunit 3
  ENSP ID: ENSP00000433853
  MOD_RES (1)..(1): Any amino acid
XEECPETAEAKCAAPRPPSSSPEQSASDACLLLLRTGQPSAPGDTSVNGPV

SEQ ID NO: 68940 - protein, 112 aa, Homo sapiens
  Payload ID: 13706
  Gene Symbol: PPP6R3
  Gene Name: protein phosphatase 6, regulatory subunit 3
  ENSP ID: ENSP00000434426
  MOD_RES (1)..(1): Any amino acid
XKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQKNTPTFIALWLCK

SEQ ID NO: 68941 - protein, 641 aa, Homo sapiens
  Payload ID: 13706
  Gene Symbol: PPP6R3
  Gene Name: protein phosphatase 6, regulatory subunit 3
  ENSP ID: ENSP00000434429
MNDRLGEDESLLMKLYSFLLNDSPLNPLLASFFSKVLSILISRKPEQIVDFLKKKHDFVDLIIKHIGTSAIMDLLLRLLTCIEPPQPRQDVLNKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68942 - protein, 580 aa, Homo sapiens
  Payload ID: 13706
  Gene Symbol: PPP6R3
  Gene Name: protein phosphatase 6, regulatory subunit 3
  ENSP ID: ENSP00000436209
QILLTLLETRRPTFEGHIEICPPGMSHSACSVNKSVLEAIRGRLGSFHELLLEPPKLFLLQKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 68943 - protein, 109 aa, Homo sapiens
  Payload ID: 13706
  Gene Symbol: PPP6R3
  Gene Name: protein phosphatase 6, regulatory subunit 3
  ENSP ID: ENSP00000436601
  MOD_RES (1)..(1): Any amino acid
XSPVEMETSTEPMDPLTPSAAALAVQPEAAGSVAMEASSDGEEDAESTDKVTETVMNGGMKETLSLTVDAKTETAVFKRFFDTFTESAVLLTCSRGHIIPPNSSFLGVF

SEQ ID NO: 68944 - protein, 8 aa, Homo sapiens
  Payload ID: 13706
  Gene Symbol: PPP6R3
  Gene Name: protein phosphatase 6, regulatory subunit 3
  ENSP ID: ENSP00000436789
MFWKFDLH

SEQ ID NO: 68945 - protein, 791 aa, Homo sapiens
  Payload ID: 13706
  Gene Symbol: PPP6R3
  Gene Name: protein phosphatase 6, regulatory subunit 3
  Uniprot ID: Q5H9R7
  ENSP ID: ENSP00000437329
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQSGVEIPALPGQWSQQ

SEQ ID NO: 68946 - protein, 386 aa, Homo sapiens
  Payload ID: 13707
  Gene Symbol: PPME1
  Gene Name: protein phosphatase methylesterase 1
  Uniprot ID: Q9Y570
  ENSP ID: ENSP00000329867
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 68947 - protein, 400 aa, Homo sapiens
  Payload ID: 13707
  Gene Symbol: PPME1
  Gene Name: protein phosphatase methylesterase 1
  Uniprot ID: Q9Y570
  ENSP ID: ENSP00000381461
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMEGLPSETQNLLLFLQTKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 68948 - protein, 135 aa, Homo sapiens
  Payload ID: 13707
  Gene Symbol: PPME1
  Gene Name: protein phosphatase methylesterase 1
  ENSP ID: ENSP00000484654
MSGHLPWAEARLLQGPPAPSPATEQPRLNTAHAQSHRPKPMELFLIIKFNHFHNWFLEVCSAPLLFKPTASLCHLWISHHSTQKHYSLASPVFAFFQLPRHSTVACPYCPGTPFPRAGRGSVLKPIFSVTVLGDV

SEQ ID NO: 68949 - protein, 591 aa, Homo sapiens
  Payload ID: 13708
  Gene Symbol: PPEF1
  Gene Name: protein phosphatase, EF-hand calcium binding domain 1
  Uniprot ID: O14829
  ENSP ID: ENSP00000341892
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 68950 - protein, 653 aa, Homo sapiens
  Payload ID: 13708
  Gene Symbol: PPEF1
  Gene Name: protein phosphatase, EF-hand calcium binding domain 1
  Uniprot ID: O14829
  ENSP ID: ENSP00000354871
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 68951 - protein, 178 aa, Homo sapiens
  Payload ID: 13708
  Gene Symbol: PPEF1
  Gene Name: protein phosphatase, EF-hand calcium binding domain 1
  ENSP ID: ENSP00000418623
MPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGV

SEQ ID NO: 68952 - protein, 115 aa, Homo sapiens
  Payload ID: 13708
  Gene Symbol: PPEF1
  Gene Name: protein phosphatase, EF-hand calcium binding domain 1
  ENSP ID: ENSP00000419273
EKVTLLVLSNFKTTENQAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 68953 - protein, 96 aa, Homo sapiens
  Payload ID: 13708
  Gene Symbol: PPEF1
  Gene Name: protein phosphatase, EF-hand calcium binding domain 1
  ENSP ID: ENSP00000419948
MRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYK

SEQ ID NO: 68954 - protein, 753 aa, Homo sapiens
  Payload ID: 13709
  Gene Symbol: PPEF2
  Gene Name: protein phosphatase, EF-hand calcium binding domain 2
  Uniprot ID: O14830
  ENSP ID: ENSP00000286719
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPRLSFPLLPDHATALVEAFRLKQQLHARYVLNLLYETKKHLVQLPNINRVSTCYSEEITVCGDLHGQLDDLIFIFYKNGLPSPERSYVFNGDFVDRGKDSVEILMILFAFMLVYPKEFHLNRGNHEDHMVNLRYGFTKEVMNKYKVHGKEILRTLQDVFCWLPLATLIDEKVLILHGGVSDITDLELLDKIERSKIVSTMRCKTRQKSEKQMEEKRRANQKSSAQGPIPWFLPESRSLPSSPLRLGSYKAQKTSRSSSIPCSGSLDGRELSRQVRSSVELELERCRQQAGLLVTGEKEEPSRSASEADSEAGELRKPTQEEWRQVVDILWSDPMAQEGCKANTIRGGGCYFGPDVTQQLLQKYNMQFLIRSHECKPEGYEFCHNRKVLTIFSASNYYEVGSNRGAYVKLGPALTPHIVQYQANKVTHTLTMRQRISRVEESALRALREKLFAHSSDLLSEFKKHDADKVGLITLSDWAAAVESVLHLGLPWRMLRPQLVNSSADNMLEYKSWLKNLAKEQLSRENIQSSLLETLYRNRSNLETIFRIIDSDHSGFISLDEFRQTWKLFSSHMNIDITDDCICDLARSIDFNKDGHIDINEFLEAFRLVEKSCPEGDASECPQATNAKDSGCSSPGAH

SEQ ID NO: 68955 - protein, 139 aa, Homo sapiens
  Payload ID: 13709
  Gene Symbol: PPEF2
  Gene Name: protein phosphatase, EF-hand calcium binding domain 2
  ENSP ID: ENSP00000426186
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPRLSFPLLPDHATALVEAFRLKQ

SEQ ID NO: 68956 - protein, 598 aa, Homo sapiens
  Payload ID: 13709
  Gene Symbol: PPEF2
  Gene Name: protein phosphatase, EF-hand calcium binding domain 2
  Uniprot ID: O14830
  ENSP ID: ENSP00000483398
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPRLSFPLLPDHATALVEAFRLKQQLHARYVLNLLYETKKHLVQLPNINRVSTCYSEEITVCGDLHGQLDDLIFIFYKNGLPSPERSYVFNGDFVDRGKDSVEILMILFAFMLVYPKEFHLNRGNHEDHMVNLRYGFTKEVMNKYKVHGKEILRTLQDVFCWLPLATLIDEKVLILHGGVSDITDLELLDKIERSKIVSTMRCKTRQKSEKQMEEKRRANQKSSAQGPIPWFLPESRSLPSSPLRLGSYKAQKTSRSSSIPCSGSLDGRELSRQVRSSVELELERCRQQAGLLVTGEKEEPSRSASEADSEAGELRKPTQEEWRQVVDILWSDPMAQEGCKANTIRGGGCYFGPDVTQQLLQKYNMQFLIRSHECKPEGYEFCHNRKVLTIFSASNYYEVGSNRGAYVKLGPALTPHIVQYQANKVTHTLTMRQRISRVEESALRALREKLFAHSSDLLSEFKKHDADKVGLASSQLCYYQQK

SEQ ID NO: 68957 - protein, 324 aa, Homo sapiens
  Payload ID: 13710
  Gene Symbol: PPM1A
  Gene Name: protein phosphatase, Mg2+/Mn2+ dependent, 1A
  Uniprot ID: P35813
  ENSP ID: ENSP00000314850
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEGGSFNKK

SEQ ID NO: 68958 - protein, 455 aa, Homo sapiens
  Payload ID: 13710
  Gene Symbol: PPM1A
  Gene Name: protein phosphatase, Mg2+/Mn2+ dependent, 1A
  Uniprot ID: P35813
  ENSP ID: ENSP00000327255
MFCSGRKWVAEATICTKLMKREKRRMGKRRAKKAKREEKKKGGERRRNEKRGNQMKRMCERKKYETDLEDQDIMGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 68959 - protein, 382 aa, Homo sapiens
  Payload ID: 13710
  Gene Symbol: PPM1A
  Gene Name: protein phosphatase, Mg2+/Mn2+ dependent, 1A
  Uniprot ID: P35813
  ENSP ID: ENSP00000378514
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 68960 - protein, 128 aa, Homo sapiens
  Payload ID: 13710
  Gene Symbol: PPM1A
  Gene Name: protein phosphatase, Mg2+/Mn2+ dependent, 1A
  ENSP ID: ENSP00000431453
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGST

SEQ ID NO: 68961 - protein, 187 aa, Homo sapiens
  Payload ID: 13710
  Gene Symbol: PPM1A
  Gene Name: protein phosphatase, Mg2+/Mn2+ dependent, 1A
  ENSP ID: ENSP00000435398
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRV

SEQ ID NO: 68962 - protein, 148 aa, Homo sapiens
  Payload ID: 13710
  Gene Symbol: PPM1A
  Gene Name: protein phosphatase, Mg2+/Mn2+ dependent, 1A
  ENSP ID: ENSP00000435575
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSR

SEQ ID NO: 68963 - protein, 164 aa, Homo sapiens
  Payload ID: 13710
  Gene Symbol: PPM1A
  Gene Name: protein phosphatase, Mg2+/Mn2+ dependent, 1A
  ENSP ID: ENSP00000436445
MFCSGRKWVAEATICTKLMKREKRRMGKRRAKKAKREEKKKGGERRRNEKRGNQMKRMCERKKYETDLEDQDIMGAFLDKPKMEKHNAQGQGNGLRYGLSSMQGKSRQHECDFDLFSKCTQSIARSSEEGGRVGQVPGMQSRRNHKEAGGRRPRLSPCDAHISE

SEQ ID NO: 68964 - protein, 93 aa, Homo sapiens
  Payload ID: 13710
  Gene Symbol: PPM1A
  Gene Name: protein phosphatase, Mg2+/Mn2+ dependent, 1A
  ENSP ID: ENSP00000437200
MFCSGRKWVAEATICTKLMKREKRRMGKRRAKKAKREEKKKGGERRRNEKRGNQMKRMCERKKYETVLCFEKFRSTDNTSAVMRLSLYSRTDL

SEQ ID NO: 68965 - protein, 479 aa, Homo sapiens
  Payload ID: 13711
  Gene Symbol: PPM1B
  Gene Name: protein phosphatase, Mg2+/Mn2+ dependent, 1B
  Uniprot ID: O75688
  ENSP ID: ENSP00000282412
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 68966 - protein, 192 aa, Homo sapiens
  Payload ID: 13711
  Gene Symbol: PPM1B
  Gene Name: protein phosphatase, Mg2+/Mn2+ dependent, 1B
  Uniprot ID: O75688
  ENSP ID: ENSP00000326089
MSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 68967 - protein, 387 aa, Homo sapiens
  Payload ID: 13711
  Gene Symbol: PPM1B
  Gene Name: protein phosphatase, Mg2+/Mn2+ dependent, 1B
  Uniprot ID: O75688
  ENSP ID: ENSP00000367813
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGGAGDLEDPW

SEQ ID NO: 68968 - protein, 303 aa, Homo sapiens
  Payload ID: 13711
  Gene Symbol: PPM1B
  Gene Name: protein phosphatase, Mg2+/Mn2+ dependent, 1B
  ENSP ID: ENSP00000386982
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVSDEAVKKDSELDKHLESRVEEIMEKSGEEGMPDLAHVMRILSAENIPNLPPGGGLAGKRNVIEAVYSRLNPHRESDG

SEQ ID NO: 68969 - protein, 380 aa, Homo sapiens
  Payload ID: 13711
  Gene Symbol: PPM1B
  Gene Name: protein phosphatase, Mg2+/Mn2+ dependent, 1B
  Uniprot ID: O75688
  ENSP ID: ENSP00000387287
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGQK

SEQ ID NO: 68970 - protein, 378 aa, Homo sapiens
  Payload ID: 13711
  Gene Symbol: PPM1B
  Gene Name: protein phosphatase, Mg2+/Mn2+ dependent, 1B
  ENSP ID: ENSP00000390087
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDG

SEQ ID NO: 68971 - protein, 605 aa, Homo sapiens
  Payload ID: 13712
  Gene Symbol: PPM1D
  Gene Name: protein phosphatase, Mg2+/Mn2+ dependent, 1D
  Uniprot ID: O15297
  ENSP ID: ENSP00000306682
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 68972 - protein, 430 aa, Homo sapiens
  Payload ID: 13712
  Gene Symbol: PPM1D
  Gene Name: protein phosphatase, Mg2+/Mn2+ dependent, 1D
  Uniprot ID: O15297
  ENSP ID: ENSP00000376720
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKDFGFELDSRK

SEQ ID NO: 68973 - protein, 125 aa, Homo sapiens
  Payload ID: 13712
  Gene Symbol: PPM1D
  Gene Name: protein phosphatase, Mg2+/Mn2+ dependent, 1D
  ENSP ID: ENSP00000465168
MMEPVHSAWATEEKTEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPF

SEQ ID NO: 68974 - protein, 430 aa, Homo sapiens; identical to SEQ ID NO: 68972
  Payload ID: 13712
  Gene Symbol: PPM1D
  Gene Name: protein phosphatase, Mg2+/Mn2+ dependent, 1D
  Uniprot ID: O15297
  ENSP ID: ENSP00000486573

SEQ ID NO: 68975 - protein, 755 aa, Homo sapiens
  Payload ID: 13713
  Gene Symbol: PPM1E
  Gene Name: protein phosphatase, Mg2+/Mn2+ dependent, 1E
  Uniprot ID: Q8WY54
  ENSP ID: ENSP00000312411
MAGCIPEEKTYRRFLELFLGEFRGPCGGGEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 68976 - protein, 454 aa, Homo sapiens
  Payload ID: 13714
  Gene Symbol: PPM1F
  Gene Name: protein phosphatase, Mg2+/Mn2+ dependent, 1F
  Uniprot ID: P49593
  ENSP ID: ENSP00000263212
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 68977 - protein, 361 aa, Homo sapiens
  Payload ID: 13714
  Gene Symbol: PPM1F
  Gene Name: protein phosphatase, Mg2+/Mn2+ dependent, 1F
  ENSP ID: ENSP00000380632
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGESQRGRPKWEKVSRKPRPRVWPAAHQGFREAV

SEQ ID NO: 68978 - protein, 286 aa, Homo sapiens
  Payload ID: 13714
  Gene Symbol: PPM1F
  Gene Name: protein phosphatase, Mg2+/Mn2+ dependent, 1F
  ENSP ID: ENSP00000384930
MEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 68979 - protein, 82 aa, Homo sapiens
  Payload ID: 13714
  Gene Symbol: PPM1F
  Gene Name: protein phosphatase, Mg2+/Mn2+ dependent, 1F
  ENSP ID: ENSP00000388350
MGLCPSTRETAPPAVLDAQSLAQSFFNRLWEVAGQWQKQVPLAARASQRQWLVSIHAIRNTRRKMEDRHVSLPSFNQLFGLS

SEQ ID NO: 68980 - protein, 89 aa, Homo sapiens
  Payload ID: 13714
  Gene Symbol: PPM1F
  Gene Name: protein phosphatase, Mg2+/Mn2+ dependent, 1F
  ENSP ID: ENSP00000392372
MEDRHVSLPSFNQLFGLSDPVNRAYFAVFDGHGGVDAARYAAVHVHTNAARQPELPTDPEGALREAFRRTDQMFLRKAKRERLQSGTTG

SEQ ID NO: 68981 - protein, 546 aa, Homo sapiens
  Payload ID: 13715
  Gene Symbol: PPM1G
  Gene Name: protein phosphatase, Mg2+/Mn2+ dependent, 1G
  Uniprot ID: O15355
  ENSP ID: ENSP00000342778
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 68982 - protein, 514 aa, Homo sapiens
  Payload ID: 13716
  Gene Symbol: PPM1H
  Gene Name: protein phosphatase, Mg2+/Mn2+ dependent, 1H
  Uniprot ID: Q9ULR3
  ENSP ID: ENSP00000228705
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 68983 - protein, 505 aa, Homo sapiens
  Payload ID: 13717
  Gene Symbol: PPM1J
  Gene Name: protein phosphatase, Mg2+/Mn2+ dependent, 1J
  Uniprot ID: Q5JR12
  ENSP ID: ENSP00000308926
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 68984 - protein, 150 aa, Homo sapiens
  Payload ID: 13717
  Gene Symbol: PPM1J
  Gene Name: protein phosphatase, Mg2+/Mn2+ dependent, 1J
  ENSP ID: ENSP00000474145
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAETLFCPRARRAESPAKDELASSPSRPGSLKAKGHQCWQESAQ

SEQ ID NO: 68985 - protein, 298 aa, Homo sapiens
  Payload ID: 13717
  Gene Symbol: PPM1J
  Gene Name: protein phosphatase, Mg2+/Mn2+ dependent, 1J
  ENSP ID: ENSP00000474405
  MOD_RES (1)..(1): Any amino acid
XGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMQDEQMARERRGHQVEGGCCALVVIYLLGKVYVANAGDSRAIIVRNGEIIPMSREFTPETERQRLQLLGLL

SEQ ID NO: 68986 - protein, 299 aa, Homo sapiens
  Payload ID: 13717
  Gene Symbol: PPM1J
  Gene Name: protein phosphatase, Mg2+/Mn2+ dependent, 1J
  Uniprot ID: Q5JR12
  ENSP ID: ENSP00000475711
MASRLLHRHIREQLKDLKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 68987 - protein, 327 aa, Homo sapiens
  Payload ID: 13718
  Gene Symbol: PPM1K
  Gene Name: protein phosphatase, Mg2+/Mn2+ dependent, 1K
  ENSP ID: ENSP00000295908
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKAIQYGTEDNSTAVVVPFGAWGKYKNSEINFSFSRSFASSGRWA

SEQ ID NO: 68988 - protein, 153 aa, Homo sapiens
  Payload ID: 13718
  Gene Symbol: PPM1K
  Gene Name: protein phosphatase, Mg2+/Mn2+ dependent, 1K
  ENSP ID: ENSP00000476452
MKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 68989 - protein, 21 aa, Homo sapiens
  Payload ID: 13718
  Gene Symbol: PPM1K
  Gene Name: protein phosphatase, Mg2+/Mn2+ dependent, 1K
  ENSP ID: ENSP00000476789
MKLTIDHTPERKDEKERIKKC

SEQ ID NO: 68990 - protein, 130 aa, Homo sapiens
  Payload ID: 13718
  Gene Symbol: PPM1K
  Gene Name: protein phosphatase, Mg2+/Mn2+ dependent, 1K
  ENSP ID: ENSP00000477051
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHG

SEQ ID NO: 68991 - protein, 5 aa, Homo sapiens
  Payload ID: 13718
  Gene Symbol: PPM1K
  Gene Name: protein phosphatase, Mg2+/Mn2+ dependent, 1K
  ENSP ID: ENSP00000477211
MSTAA

SEQ ID NO: 68992 - protein, 182 aa, Homo sapiens
  Payload ID: 13718
  Gene Symbol: PPM1K
  Gene Name: protein phosphatase, Mg2+/Mn2+ dependent, 1K
  ENSP ID: ENSP00000477241
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADGM

SEQ ID NO: 68993 - protein, 372 aa, Homo sapiens
  Payload ID: 13718
  Gene Symbol: PPM1K
  Gene Name: protein phosphatase, Mg2+/Mn2+ dependent, 1K
  Uniprot ID: Q8N3J5
  ENSP ID: ENSP00000477341
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 68994 - protein, 233 aa, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENSP ID: ENSP00000295839
MPAFSTTAAEYVKSRLPEALKQHLQDYEKDKENSVLSYQTILEQQILSIDREMLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 68995 - protein, 360 aa, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENSP ID: ENSP00000417659
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 68996 - protein, 194 aa, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENSP ID: ENSP00000420354
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAVTF

SEQ ID NO: 68997 - protein, 181 aa, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENSP ID: ENSP00000420746
MLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 68998 - protein, 270 aa, Homo sapiens
  Payload ID: 13720
  Gene Symbol: PPM1M
  Gene Name: protein phosphatase, Mg2+/Mn2+ dependent, 1M
  Uniprot ID: Q96MI6
  ENSP ID: ENSP00000296487
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRYCSCWGPAWAWVGASSKPK

SEQ ID NO: 68999 - protein, 459 aa, Homo sapiens
  Payload ID: 13720
  Gene Symbol: PPM1M
  Gene Name: protein phosphatase, Mg2+/Mn2+ dependent, 1M
  ENSP ID: ENSP00000319894
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 69000 - protein, 247 aa, Homo sapiens
  Payload ID: 13720
  Gene Symbol: PPM1M
  Gene Name: protein phosphatase, Mg2+/Mn2+ dependent, 1M
  Uniprot ID: Q96MI6
  ENSP ID: ENSP00000387046
MGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 69001 - protein, 121 aa, Homo sapiens
  Payload ID: 13720
  Gene Symbol: PPM1M
  Gene Name: protein phosphatase, Mg2+/Mn2+ dependent, 1M
  ENSP ID: ENSP00000412344
  MOD_RES (1)..(1): Any amino acid
XLLGTLAVSRGLGDHQLRVLDTNIQLKPFLLSVPQVTVLDVDQLELQEDDVVVMATDGLWDVLSNEQVAWLVRSFLPGNQEDPHSLSAGWSSQVLKAGPDADTQHTGKGRQSHRGRAGVLR

SEQ ID NO: 69002 - protein, 257 aa, Homo sapiens
  Payload ID: 13720
  Gene Symbol: PPM1M
  Gene Name: protein phosphatase, Mg2+/Mn2+ dependent, 1M
  ENSP ID: ENSP00000413556
  MOD_RES (1)..(1): Any amino acid
XPGPHASPVPYRRPRFLRGSSSSPGAADASRRPDSRPVRSPARGRTLPWNAGYAEIINAEKSEFNEDQAACGKLCIRRCEFGAEEEWLTLCPEEDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQ

SEQ ID NO: 69003 - protein, 112 aa, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENSP ID: ENSP00000379961
MTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 69004 - protein, 137 aa, Homo sapiens
  Payload ID: 13721
  Gene Symbol: PPM1N
  Gene Name: protein phosphatase, Mg2+/Mn2+ dependent, 1N (putative)
  ENSP ID: ENSP00000379962
MTCILVCFPGAPRPSEEAIRRELALDAALGCRIAELCASAQKPPSLNTVFRTLASEDIPDLPPGGGLDCKSQKSAERRGRMGLGSPTPRIWAQPWTWRPDSCCPLGILCFSGASTELKKKTDPFPNYMYQRKEGRPM

SEQ ID NO: 69005 - protein, 112 aa, Homo sapiens; identical to SEQ ID NO: 69003
  Payload ID: 13721
  Gene Symbol: PPM1N
  Gene Name: protein phosphatase, Mg2+/Mn2+ dependent, 1N (putative)
  Uniprot ID: Q8N819
  ENSP ID: ENSP00000379963

SEQ ID NO: 69006 - protein, 112 aa, Homo sapiens; identical to SEQ ID NO: 69003
  Payload ID: 13721
  Gene Symbol: PPM1N
  Gene Name: protein phosphatase, Mg2+/Mn2+ dependent, 1N (putative)
  Uniprot ID: Q8N819
  ENSP ID: ENSP00000384318

SEQ ID NO: 69007 - protein, 140 aa, Homo sapiens
  Payload ID: 13721
  Gene Symbol: PPM1N
  Gene Name: protein phosphatase, Mg2+/Mn2+ dependent, 1N (putative)
  ENSP ID: ENSP00000384809
MTCILVCFPGAPRPSEEAIRRELALDAALGCRIAELCASAQKPPSLNTVFRTLASEDIPDLPPGGGLDCKSARSQKSAERRGRMGLGSPTPRIWAQPWTWRPDSCCPLGILCFSGASTELKKKTDPFPNYMYQRKEGRPM

SEQ ID NO: 69008 - protein, 130 aa, Homo sapiens
  Payload ID: 13721
  Gene Symbol: PPM1N
  Gene Name: protein phosphatase, Mg2+/Mn2+ dependent, 1N (putative)
  ENSP ID: ENSP00000389871
MTCILVCFPGAPRPSEEAIRRELALDAALGCRIAELCASAQKPPSLNTVFRTLASEDIPDLPPGGGLDCKRGRMGLGSPTPRIWAQPWTWRPDSCCPLGILCFSGASTELKKKTDPFPNYMYQRKEGRPM

SEQ ID NO: 69009 - protein, 430 aa, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENSP ID: ENSP00000397050
MAVLARQLQRLLWTACKKKEREKEGREEEEEEEAGRRAPEGPRSLLTAPRRAQRPHGGAEASGGLRFGASAAQGWRARMEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKGSLDNMTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 69010 - protein, 374 aa, Homo sapiens
  Payload ID: 13721
  Gene Symbol: PPM1N
  Gene Name: protein phosphatase, Mg2+/Mn2+ dependent, 1N (putative)
  ENSP ID: ENSP00000409511
  MOD_RES (1)..(1): Any amino acid
XLTAPRRAQRPHGGAEASGGLRFGASAAQGWRARMEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKVLGAWRGTFGAWCSRGREPRGFGEEGFDREARVKLAKEGIGLKRRAWPEVGRAKIQGRSLRDALRHGRVSGRDLRERAWSFGKGRFWVVGAGPEVLISAGRWKSR

SEQ ID NO: 69011 - protein, 402 aa, Homo sapiens
  Payload ID: 13722
  Gene Symbol: PTAR1
  Gene Name: protein prenyltransferase alpha subunit repeat containing 1
  Uniprot ID: Q7Z6K3
  ENSP ID: ENSP00000344299
MAETSEEVAVLVQRVVKDITNAFRRNPHIDEIGLIPCPEARYNRSPIVLVENKLGVESWCVKFLLPYVHNKLLLYRTRKQWLNRDELIDVTCTLLLLNPDFTTAWNVRKELILSGTLNPIKDLHLGKLALTKFPKSPETWIHRRWVLQQLIQETSLPSFVTKGNLGTIPTERAQRLIQEEMEVCGEAAGRYPSNYNAWSHRIWVLQHLAKLDVKILLDELSSTKHWASMHVSDHSGFHYRQFLLKSLISQTVIDSSVMEQNPLRSEPALVPPKDEEAAVSTEEPRINLPHLLEEEVEFSTDLIDSYPGHETLWCHRRHIFYLQHHLNAGSQLSQAMEVDGLNDSSKQGYSQETKRLKRTPVPDSLGLEMEHRFIDQVLSTCRNVEQARFASAYRKWLVTLSQ

SEQ ID NO: 69012 - protein, 350 aa, Homo sapiens
  Payload ID: 13722
  Gene Symbol: PTAR1
  Gene Name: protein prenyltransferase alpha subunit repeat containing 1
  ENSP ID: ENSP00000366405
MAETSEEVAVLVQRVVKDITNAFRRNPHMKELILSGTLNPIKDLHLGKLALTKFPKSPETWIHRRWVLQQLIQETSLPSFVTKGNLGTIPTERAQRLIQEEMEVCGEAAGRYPSNYNAWSHRIWVLQHLAKLDVKILLDELSSTKHWASMHVSDHSGFHYRQFLLKSLISQTVIDSSVMEQNPLRSEPALVPPKDEEAAVSTEEPRINLPHLLEEEVEFSTDLIDSYPGHETLWCHRRHIFYLQHHLNGRFPHSMTQLSPADSPGGTLSDLHLIPAGSQLSQAMEVDGLNDSSKQGYSQETKRLKRTPVPDSLGLEMEHRFIDQVLSTCRNVEQARFASAYRKWLVTLSQ

SEQ ID NO: 69013 - protein, 168 aa, Homo sapiens
  Payload ID: 13722
  Gene Symbol: PTAR1
  Gene Name: protein prenyltransferase alpha subunit repeat containing 1
  ENSP ID: ENSP00000405943
  MOD_RES (1)..(1): Any amino acid
XSGFHYRQFLLKSLISQTVIDSSVMEQNPLRSEPALVPPKDEEAAVSTEEPRINLPHLLEEEVEFSTDLIDSYPGHETLWCHRRHIFYLQHHLNGSQLSQAMEVDGLNDSSKQGYSQETKRLKRTPVPDSLGLEMEHRFIDQVLSTCRNVEQARFASAYRKWLVTLSQ

SEQ ID NO: 69014 - protein, 29 aa, Homo sapiens
  Payload ID: 13722
  Gene Symbol: PTAR1
  Gene Name: protein prenyltransferase alpha subunit repeat containing 1
  ENSP ID: ENSP00000440164
MAETSEEVAVLVQRVVKDITNAFRRNPHM

SEQ ID NO: 69015 - protein, 522 aa, Homo sapiens
  Payload ID: 13723
  Gene Symbol:
  Gene Name: Protein RCC2  [Source:UniProtKB/Swiss-Prot
  Acc:Q9P258]
  Uniprot ID: Q9P258
  ENSP ID: ENSP00000486099
MPRKKAAAAAWEEPSSGNGTARAGPRKRGGPAGRKRERPERCSSSSGGGSSGDEDGLELDGAPGGGKRAARPATAGKAGGAAVVITEPEHTKERVKLEGSKCKGQLLIFGATNWDLIGRKEVPKQQAAYRNLGQNLWGPHRYGCLAGVRVRTVVSGSCAAHSLLITTEGKLWSWGRNEKGQLGHGDTKRVEAPRLIEGLSHEVIVSAACGRNHTLALTETGSVFAFGENKMGQLGLGNQTDAVPSPAQIMYNGQPITKMACGAEFSMIMDCKGNLYSFGCPEYGQLGHNSDGKFIARAQRIEYDCELVPRRVAIFIEKTKDGQILPVPNVVVRDVACGANHTLVLDSQKRVFSWGFGGYGRLGHAEQKDEMVPRLVKLFDFPGRGASQIYAGYTCSFAVSEVGGLFFWGATNTSRESTMYPKAVQDLCGWRIRSLACGKSSIIVAADESTISWGPSPTFGELGYGDHKPKSSTAAQEVKTLDGIFSEQVAMGYSHSLVIARDESETEKEKIKKLPEYNPRTL

SEQ ID NO: 69016 - protein, 522 aa, Homo sapiens; identical to SEQ ID NO: 69015
  Payload ID: 13723
  Gene Symbol:
  Gene Name: Protein RCC2  [Source:UniProtKB/Swiss-Prot
  Acc:Q9P258]
  Uniprot ID: Q9P258
  ENSP ID: ENSP00000486447

SEQ ID NO: 69017 - protein, 606 aa, Homo sapiens
  Payload ID: 13724
  Gene Symbol: PRC1
  Gene Name: protein regulator of cytokinesis 1
  Uniprot ID: O43663
  ENSP ID: ENSP00000354679
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFARELSKASKSDATSGILNSTNIQS

SEQ ID NO: 69018 - protein, 620 aa, Homo sapiens
  Payload ID: 13724
  Gene Symbol: PRC1
  Gene Name: protein regulator of cytokinesis 1
  Uniprot ID: O43663
  ENSP ID: ENSP00000377793
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQRELSKASKSDATSGILNSTNIQS

SEQ ID NO: 69019 - protein, 525 aa, Homo sapiens
  Payload ID: 13724
  Gene Symbol: PRC1
  Gene Name: protein regulator of cytokinesis 1
  Uniprot ID: O43663
  ENSP ID: ENSP00000409549
MRRSEVLAEESIVCLQKALNHLREIWELIGIPEDQRLQRTEVVKKHIKEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSARTFKGFQI

SEQ ID NO: 69020 - protein, 238 aa, Homo sapiens
  Payload ID: 13724
  Gene Symbol: PRC1
  Gene Name: protein regulator of cytokinesis 1
  ENSP ID: ENSP00000451344
  MOD_RES (1)..(1): Any amino acid
XLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQDSLPPEENVFVCPKLRWPALLPKR

SEQ ID NO: 69021 - protein, 195 aa, Homo sapiens
  Payload ID: 13724
  Gene Symbol: PRC1
  Gene Name: protein regulator of cytokinesis 1
  ENSP ID: ENSP00000453063
  MOD_RES (1)..(1): Any amino acid
XYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKPVAASTCSGKKTPRTG

SEQ ID NO: 69022 - protein, 110 aa, Homo sapiens
  Payload ID: 13724
  Gene Symbol: PRC1
  Gene Name: protein regulator of cytokinesis 1
  ENSP ID: ENSP00000453117
MRRSEVLAEESIVCLQKALNHLREIWELIGIPEDQRLQRTEVVKKHIKELLDMMIAEEESLKERLIKSISVCQKELNTLCSELHVEPFQEFTWNLITVVRCLIQEEGETT

SEQ ID NO: 69023 - protein, 154 aa, Homo sapiens
  Payload ID: 13724
  Gene Symbol: PRC1
  Gene Name: protein regulator of cytokinesis 1
  ENSP ID: ENSP00000453455
MRRSEVLAEESIVCLQKALNHLREIWELIGIPEDQRLQRTEVVKKHIKEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTS

SEQ ID NO: 69024 - protein, 64 aa, Homo sapiens
  Payload ID: 13724
  Gene Symbol: PRC1
  Gene Name: protein regulator of cytokinesis 1
  ENSP ID: ENSP00000453977
  MOD_RES (1)..(1): Any amino acid
XSIRPIFGGTVYHSPVSRLPPSGSKPVAASTCSGKKTPRTGRHGANKENLELNGSILSEGSVPL

SEQ ID NO: 69025 - protein, 46 aa, Homo sapiens
  Payload ID: 13724
  Gene Symbol: PRC1
  Gene Name: protein regulator of cytokinesis 1
  ENSP ID: ENSP00000456737
RLPPSGSKPVAASTCSGKKTPRTGRHGANKENLELNGSILSGQPSS

SEQ ID NO: 69026 - protein, 231 aa, Homo sapiens
  Payload ID: 13725
  Gene Symbol: PROS1
  Gene Name: protein S (alpha)
  ENSP ID: ENSP00000330021
MRVLGGRCGALLACLLLVLPVSEANFCLYFRNDFIYNRACISVLVGLSGCNFFYSICFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDC

SEQ ID NO: 69027 - protein, 676 aa, Homo sapiens
  Payload ID: 13725
  Gene Symbol: PROS1
  Gene Name: protein S (alpha)
  Uniprot ID: P07225
  ENSP ID: ENSP00000377783
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 69028 - protein, 545 aa, Homo sapiens
  Payload ID: 13725
  Gene Symbol: PROS1
  Gene Name: protein S (alpha)
  ENSP ID: ENSP00000385794
MSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 69029 - protein, 56 aa, Homo sapiens
  Payload ID: 13725
  Gene Symbol: PROS1
  Gene Name: protein S (alpha)
  ENSP ID: ENSP00000419616
MSCKDGKASFTCTCKPGWQGEKCEFDINECKDPSNINGGCSQICDNTPGSYHCSCK

SEQ ID NO: 69030 - protein, 424 aa, Homo sapiens
  Payload ID: 13726
  Gene Symbol: PSKH1
  Gene Name: protein serine kinase H1
  Uniprot ID: P11801
  ENSP ID: ENSP00000291041
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 69031 - protein, 353 aa, Homo sapiens
  Payload ID: 13726
  Gene Symbol: PSKH1
  Gene Name: protein serine kinase H1
  ENSP ID: ENSP00000482880
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEVSLSCPCPGCWGGTCGGRYILQLSVRGMSSGPCS

SEQ ID NO: 69032 - protein, 385 aa, Homo sapiens
  Payload ID: 13727
  Gene Symbol: PSKH2
  Gene Name: protein serine kinase H2
  Uniprot ID: Q96QS6
  ENSP ID: ENSP00000276616
MGCGASRKVVPGPPALAWAKHEGQNQAGVGGAGPGPEAAAQAAQRIQVARFRAKFDPRVLARYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPLSALL

SEQ ID NO: 69033 - protein, 947 aa, Homo sapiens
  Payload ID: 13728
  Gene Symbol:
  Gene Name: Protein SOGA3  [Source:UniProtKB/Swiss-Prot
  Acc:Q5TF21]
  Uniprot ID: Q5TF21
  ENSP ID: ENSP00000455908
MSQPPIGGAAPATAAASPAAAATEARLHPEGSSRKQQRAQSPARPRDSSLRQTIAATRSPVGAGTKLNSVRQQQLQQQQQQGNKTGSRTGPPASIRGGGGGAEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAAAAAAQMHAKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRRGSKDLPKSEKKAQQTPTEEDNEDLKCQLQFVKEEAALMRKKMAKIDKEKDRFEHELQKYRSFYGDLDSPLPKGEAGGPPSTREAELKLRLRLVEEEANILGRKIVELEVENRGLKAELDDLRGDDFNGSANPLMREQSESLSELRQHLQLVEDETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 69034 - protein, 291 aa, Homo sapiens
  Payload ID: 13728
  Gene Symbol:
  Gene Name: Protein SOGA3  [Source:UniProtKB/Swiss-Prot
  Acc:Q5TF21]
  ENSP ID: ENSP00000456172
  MOD_RES (1)..(1): Any amino acid
XETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISMFQPIILLILILVLFSSLSYTTIFKLVFLFTLFFVL

SEQ ID NO: 69035 - protein, 97 aa, Homo sapiens
  Payload ID: 13728
  Gene Symbol:
  Gene Name: Protein SOGA3  [Source:UniProtKB/Swiss-Prot
  Acc:Q5TF21]
  ENSP ID: ENSP00000456668
  MOD_RES (1)..(1): Any amino acid
XLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 69036 - protein, 1065 aa, Homo sapiens
  Payload ID: 13729
  Gene Symbol: PTK2
  Gene Name: protein tyrosine kinase 2
  Uniprot ID: Q05397
  ENSP ID: ENSP00000341189
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPGKEEKNWAERNPAAPPKKPPRPGAPGHLGSLASLSSPADSYNEGVKPWRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69037 - protein, 1006 aa, Homo sapiens
  Payload ID: 13729
  Gene Symbol: PTK2
  Gene Name: protein tyrosine kinase 2
  Uniprot ID: Q05397
  ENSP ID: ENSP00000378644
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69038 - protein, 362 aa, Homo sapiens
  Payload ID: 13729
  Gene Symbol: PTK2
  Gene Name: protein tyrosine kinase 2
  ENSP ID: ENSP00000403416
MRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69039 - protein, 59 aa, Homo sapiens
  Payload ID: 13729
  Gene Symbol: PTK2
  Gene Name: protein tyrosine kinase 2
  ENSP ID: ENSP00000427762
MGVSSVREKYELAHPPEEWKYELRIRYLPKGFLNQFTEDKPTLNFFYQQVKSDYMLEIA

SEQ ID NO: 69040 - protein, 133 aa, Homo sapiens
  Payload ID: 13729
  Gene Symbol: PTK2
  Gene Name: protein tyrosine kinase 2
  ENSP ID: ENSP00000427774
MRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQ

SEQ ID NO: 69041 - protein, 119 aa, Homo sapiens
  Payload ID: 13729
  Gene Symbol: PTK2
  Gene Name: protein tyrosine kinase 2
  ENSP ID: ENSP00000427795
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEE

SEQ ID NO: 69042 - protein, 66 aa, Homo sapiens
  Payload ID: 13729
  Gene Symbol: PTK2
  Gene Name: protein tyrosine kinase 2
  ENSP ID: ENSP00000427825
MAAAYLDPNLNHTPNSSTKTHLGTGMERSPGAMERVLKVFHYFESNSEPTTWASIIRHGDATDVRI

SEQ ID NO: 69043 - protein, 121 aa, Homo sapiens
  Payload ID: 13729
  Gene Symbol: PTK2
  Gene Name: protein tyrosine kinase 2
  ENSP ID: ENSP00000427904
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWK

SEQ ID NO: 69044 - protein, 72 aa, Homo sapiens
  Payload ID: 13729
  Gene Symbol: PTK2
  Gene Name: protein tyrosine kinase 2
  ENSP ID: ENSP00000427972
TIAENMADLIDGYCRLVNGTSQSFIIRPQKEGERALPSIPKLANSEKQGMRTHAVSVSAQSWRKRRLSKKSA

SEQ ID NO: 69045 - protein, 168 aa, Homo sapiens
  Payload ID: 13729
  Gene Symbol: PTK2
  Gene Name: protein tyrosine kinase 2
  ENSP ID: ENSP00000428232
MKYQEVRCLTSFNISVSFPAETDDYAEIIDEEDTYTMPSKSYGIDEARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTA

SEQ ID NO: 69046 - protein, 72 aa, Homo sapiens
  Payload ID: 13729
  Gene Symbol: PTK2
  Gene Name: protein tyrosine kinase 2
  ENSP ID: ENSP00000428380
MKYQEVRCLTSFNISVSFPAETDDYAEIIDEEDTYTMPSTRDYEIQRERIELGRCIGEGQFGDVHQGIYMSP

SEQ ID NO: 69047 - protein, 124 aa, Homo sapiens
  Payload ID: 13729
  Gene Symbol: PTK2
  Gene Name: protein tyrosine kinase 2
  ENSP ID: ENSP00000428482
MKYQEVRCLTSFNISVSFPAETDDYAEIIDEEDTYTMPSTRDYEIQRERIELGRCIGEGQFGDVHQGIYMSPENPALAVAIKTCKNCTSDSVREKFLQEASEVIFASKEIQFGSSIFDPVCLSA

SEQ ID NO: 69048 - protein, 724 aa, Homo sapiens
  Payload ID: 13729
  Gene Symbol: PTK2
  Gene Name: protein tyrosine kinase 2
  ENSP ID: ENSP00000428492
IAENMADLIDGYCRLVNGTSQSFIIRPQKEGERALPSIPKLANSEKQGMRTHAVSVSETDDYAEIIDEEDTYTMPSKSYGIDEARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69049 - protein, 66 aa, Homo sapiens; identical to SEQ ID NO: 69042
  Payload ID: 13729
  Gene Symbol: PTK2
  Gene Name: protein tyrosine kinase 2
  ENSP ID: ENSP00000428570

SEQ ID NO: 69050 - protein, 128 aa, Homo sapiens
  Payload ID: 13729
  Gene Symbol: PTK2
  Gene Name: protein tyrosine kinase 2
  ENSP ID: ENSP00000428593
AENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGGPGLLNLKLSSAQSWRKRRLSKKSA

SEQ ID NO: 69051 - protein, 156 aa, Homo sapiens
  Payload ID: 13729
  Gene Symbol: PTK2
  Gene Name: protein tyrosine kinase 2
  ENSP ID: ENSP00000428792
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYM

SEQ ID NO: 69052 - protein, 122 aa, Homo sapiens
  Payload ID: 13729
  Gene Symbol: PTK2
  Gene Name: protein tyrosine kinase 2
  ENSP ID: ENSP00000429001
MAAAYLDPNLNHTPNSSTKTHLGTGMERSPGAMERVLKVFHYFESNSEPTTWASIIRHGDATDVRVKSDYMLEIADQVDQEIALKLGCLEIRKDVGLKRFFPKSLLDSVKAKTLRKLIQQTF

SEQ ID NO: 69053 - protein, 319 aa, Homo sapiens
  Payload ID: 13729
  Gene Symbol: PTK2
  Gene Name: protein tyrosine kinase 2
  ENSP ID: ENSP00000429023
  MOD_RES (1)..(1): Any amino acid
XEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEACHYTSLHWNWCRYISDPNVDAAQTPGMQSNNASV

SEQ ID NO: 69054 - protein, 14 aa, Homo sapiens
  Payload ID: 13729
  Gene Symbol: PTK2
  Gene Name: protein tyrosine kinase 2
  ENSP ID: ENSP00000429028
MLLELAGQEALKPA

SEQ ID NO: 69055 - protein, 1096 aa, Homo sapiens
  Payload ID: 13729
  Gene Symbol: PTK2
  Gene Name: protein tyrosine kinase 2
  ENSP ID: ENSP00000429082
MLLELAGQEALKPAGAIYMEKSGCSPFPVCWAKEYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69056 - protein, 1096 aa, Homo sapiens; identical to SEQ ID NO: 69055
  Payload ID: 13729
  Gene Symbol: PTK2
  Gene Name: protein tyrosine kinase 2
  ENSP ID: ENSP00000429129

SEQ ID NO: 69057 - protein, 680 aa, Homo sapiens
  Payload ID: 13729
  Gene Symbol: PTK2
  Gene Name: protein tyrosine kinase 2
  ENSP ID: ENSP00000429170
MKYQEVRCLTSFNISVSFPAETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69058 - protein, 65 aa, Homo sapiens
  Payload ID: 13729
  Gene Symbol: PTK2
  Gene Name: protein tyrosine kinase 2
  ENSP ID: ENSP00000429409
MAAAYLDPNLNHTPNSSTKTHLGTGMERSPGAMERVLKVFHYFESNSEPTTWASIIRHGDATDVR

SEQ ID NO: 69059 - protein, 67 aa, Homo sapiens
  Payload ID: 13729
  Gene Symbol: PTK2
  Gene Name: protein tyrosine kinase 2
  ENSP ID: ENSP00000429437
MRLRFCISSQEYNINNAESFSASYPETYDVQGMFQLTNWTLTSEGRLDTTPVGDSFAQAVLPRQPPE

SEQ ID NO: 69060 - protein, 1052 aa, Homo sapiens
  Payload ID: 13729
  Gene Symbol: PTK2
  Gene Name: protein tyrosine kinase 2
  Uniprot ID: Q05397
  ENSP ID: ENSP00000429474
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69061 - protein, 120 aa, Homo sapiens
  Payload ID: 13729
  Gene Symbol: PTK2
  Gene Name: protein tyrosine kinase 2
  ENSP ID: ENSP00000429530
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEW

SEQ ID NO: 69062 - protein, 67 aa, Homo sapiens
  Payload ID: 13729
  Gene Symbol: PTK2
  Gene Name: protein tyrosine kinase 2
  ENSP ID: ENSP00000429702
MRMESRRQATVSWDSGGSDEAPPKPSRPGYPSPRSSEGFYPSPQHMVQTNHYQVSGYPGSHGITAMA

SEQ ID NO: 69063 - protein, 66 aa, Homo sapiens; identical to SEQ ID NO: 69042
  Payload ID: 13729
  Gene Symbol: PTK2
  Gene Name: protein tyrosine kinase 2
  ENSP ID: ENSP00000429895

SEQ ID NO: 69064 - protein, 107 aa, Homo sapiens
  Payload ID: 13729
  Gene Symbol: PTK2
  Gene Name: protein tyrosine kinase 2
  ENSP ID: ENSP00000429907
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSV

SEQ ID NO: 69065 - protein, 1052 aa, Homo sapiens; identical to SEQ ID NO: 69060
  Payload ID: 13729
  Gene Symbol: PTK2
  Gene Name: protein tyrosine kinase 2
  Uniprot ID: Q05397
  ENSP ID: ENSP00000429911

SEQ ID NO: 69066 - protein, 1017 aa, Homo sapiens
  Payload ID: 13729
  Gene Symbol: PTK2
  Gene Name: protein tyrosine kinase 2
  ENSP ID: ENSP00000429929
  MOD_RES (1)..(1): Any amino acid
XYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69067 - protein, 79 aa, Homo sapiens
  Payload ID: 13729
  Gene Symbol: PTK2
  Gene Name: protein tyrosine kinase 2
  ENSP ID: ENSP00000429958
MKYQEVRCLTSFNISVSFPAETDDYAEIIDEEDTYTMPSTRDYEIQRERIELGRCIGEGQFGDVHQGIYMSPVCVCGRY

SEQ ID NO: 69068 - protein, 51 aa, Homo sapiens
  Payload ID: 13729
  Gene Symbol: PTK2
  Gene Name: protein tyrosine kinase 2
  ENSP ID: ENSP00000430037
MAAAYLDPNLNHTPNSSTKTHLGTGMERSPGAMERVLKVFHYFESNSEPTT

SEQ ID NO: 69069 - protein, 117 aa, Homo sapiens
  Payload ID: 13729
  Gene Symbol: PTK2
  Gene Name: protein tyrosine kinase 2
  ENSP ID: ENSP00000430044
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPP

SEQ ID NO: 69070 - protein, 121 aa, Homo sapiens; identical to SEQ ID NO: 69043
  Payload ID: 13729
  Gene Symbol: PTK2
  Gene Name: protein tyrosine kinase 2
  ENSP ID: ENSP00000430277

SEQ ID NO: 69071 - protein, 753 aa, Homo sapiens
  Payload ID: 13729
  Gene Symbol: PTK2
  Gene Name: protein tyrosine kinase 2
  ENSP ID: ENSP00000430603
AENMADLIDGYCRLVNGTSQSFIIRPQKEGERALPSIPKLANSEKQGMRTHAVSVSGVSHCQHKVKKARRFLPLVFCSHDPPSTDEISGDETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKPWRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69072 - protein, 120 aa, Homo sapiens
  Payload ID: 13729
  Gene Symbol: PTK2
  Gene Name: protein tyrosine kinase 2
  ENSP ID: ENSP00000430828
MRLRFCISSQEYNINNAESFSASYPETYDVQGMFQLTNWTLTSEGRLDTTPVGDSFIEMAQKLLNSDLGELINKMKLAQQYVMTSLQQEYKKQMLTAAHALAVDAKNLLDVIDQARLKML

SEQ ID NO: 69073 - protein, 115 aa, Homo sapiens
  Payload ID: 13729
  Gene Symbol: PTK2
  Gene Name: protein tyrosine kinase 2
  ENSP ID: ENSP00000430916
MSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 69074 - protein, 117 aa, Homo sapiens; identical to SEQ ID NO: 69069
  Payload ID: 13729
  Gene Symbol: PTK2
  Gene Name: protein tyrosine kinase 2
  ENSP ID: ENSP00000430951

SEQ ID NO: 69075 - protein, 8 aa, Homo sapiens
  Payload ID: 13729
  Gene Symbol: PTK2
  Gene Name: protein tyrosine kinase 2
  ENSP ID: ENSP00000431023
MLLELAGQ

SEQ ID NO: 69076 - protein, 132 aa, Homo sapiens
  Payload ID: 13729
  Gene Symbol: PTK2
  Gene Name: protein tyrosine kinase 2
  ENSP ID: ENSP00000431106
MRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEED

SEQ ID NO: 69077 - protein, 1009 aa, Homo sapiens
  Payload ID: 13730
  Gene Symbol: PTK2B
  Gene Name: protein tyrosine kinase 2 beta
  Uniprot ID: Q14289
  ENSP ID: ENSP00000332816
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 69078 - protein, 596 aa, Homo sapiens
  Payload ID: 13730
  Gene Symbol: PTK2B
  Gene Name: protein tyrosine kinase 2 beta
  ENSP ID: ENSP00000380634
MGRTALEQQSTLLLFQQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQEEDFIQPSSREEAQQLWEAEKVKMRQILDKQQKQMVEDYQWLRQEEKSLDPMVYMNDKSPLTPEKEVGYRECSRPSSGGFLLAPCAEPPSLPTAQGREQRSLSAFPAASAMI

SEQ ID NO: 69079 - protein, 1009 aa, Homo sapiens; identical to SEQ ID NO: 69077
  Payload ID: 13730
  Gene Symbol: PTK2B
  Gene Name: protein tyrosine kinase 2 beta
  Uniprot ID: Q14289
  ENSP ID: ENSP00000380638

SEQ ID NO: 69080 - protein, 967 aa, Homo sapiens
  Payload ID: 13730
  Gene Symbol: PTK2B
  Gene Name: protein tyrosine kinase 2 beta
  Uniprot ID: Q14289
  ENSP ID: ENSP00000391995
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQEEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 69081 - protein, 213 aa, Homo sapiens
  Payload ID: 13730
  Gene Symbol: PTK2B
  Gene Name: protein tyrosine kinase 2 beta
  ENSP ID: ENSP00000416174
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLF

SEQ ID NO: 69082 - protein, 967 aa, Homo sapiens; identical to SEQ ID NO: 69080
  Payload ID: 13730
  Gene Symbol: PTK2B
  Gene Name: protein tyrosine kinase 2 beta
  Uniprot ID: Q14289
  ENSP ID: ENSP00000427931

SEQ ID NO: 69083 - protein, 184 aa, Homo sapiens
  Payload ID: 13730
  Gene Symbol: PTK2B
  Gene Name: protein tyrosine kinase 2 beta
  ENSP ID: ENSP00000428271
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELR

SEQ ID NO: 69084 - protein, 194 aa, Homo sapiens
  Payload ID: 13730
  Gene Symbol: PTK2B
  Gene Name: protein tyrosine kinase 2 beta
  ENSP ID: ENSP00000428837
  MOD_RES (1)..(1): Any amino acid
XRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQDGEKRNSLPQIPMLNLEARRSHLSESCSIESDIYAEIPDETLRRPGGPQYGIAREDVVLNRILGE

SEQ ID NO: 69085 - protein, 68 aa, Homo sapiens
  Payload ID: 13730
  Gene Symbol: PTK2B
  Gene Name: protein tyrosine kinase 2 beta
  ENSP ID: ENSP00000429694
MSGVSEPLSRVKLGTLRRPEGPAEPMVVVPVDVEKEDVRILKVCFYSNSFNPGKNFKLVKCTVQTEIR

SEQ ID NO: 69086 - protein, 103 aa, Homo sapiens
  Payload ID: 13730
  Gene Symbol: PTK2B
  Gene Name: protein tyrosine kinase 2 beta
  ENSP ID: ENSP00000430404
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIH

SEQ ID NO: 69087 - protein, 134 aa, Homo sapiens
  Payload ID: 13731
  Gene Symbol: PTK6
  Gene Name: protein tyrosine kinase 6
  Uniprot ID: Q13882
  ENSP ID: ENSP00000217185
MVSRDQAHLGPKYVGLWDFKSRTDEELSFRAGDVFHVARKEEQWWWATLLDEAGGAVAQGYVPHNYLAERETVESEPAGHAGCAALQDLAACRGPAAPERGGVLPQPARACELPQGPEPVPRPAAGRALPEARA

SEQ ID NO: 69088 - protein, 451 aa, Homo sapiens
  Payload ID: 13731
  Gene Symbol: PTK6
  Gene Name: protein tyrosine kinase 6
  Uniprot ID: Q13882
  ENSP ID: ENSP00000442460
MVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 69089 - protein, 816 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000230418
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 69090 - protein, 1070 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000230419
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69091 - protein, 940 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000325462
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69092 - protein, 1030 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000325992
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69093 - protein, 1014 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000326029
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69094 - protein, 139 aa, Homo sapiens
  Payload ID: 13732
  Gene Symbol: PTK7
  Gene Name: protein tyrosine kinase 7 (inactive)
  ENSP ID: ENSP00000417607
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKCESQGGCAQSPCQTLND

SEQ ID NO: 69095 - protein, 84 aa, Homo sapiens
  Payload ID: 13732
  Gene Symbol: PTK7
  Gene Name: protein tyrosine kinase 7 (inactive)
  ENSP ID: ENSP00000418386
MVARVSGLIVTLLSSSFPGGPLQNGQPSAEIQEEVALTSLGSGPAATNKRHSTSDKMHFPRSSLQPITTLGRPQAVPEDFQEQG

SEQ ID NO: 69096 - protein, 25 aa, Homo sapiens
  Payload ID: 13732
  Gene Symbol: PTK7
  Gene Name: protein tyrosine kinase 7 (inactive)
  ENSP ID: ENSP00000418462
  MOD_RES (1)..(1): Any amino acid
XEHGTEAIFVAAVGIRPSHHAAAQS

SEQ ID NO: 69097 - protein, 25 aa, Homo sapiens
  Payload ID: 13732
  Gene Symbol: PTK7
  Gene Name: protein tyrosine kinase 7 (inactive)
  ENSP ID: ENSP00000418545
TEHGTEAIFVAAVGIRPSHHAAAQS

SEQ ID NO: 69098 - protein, 1078 aa, Homo sapiens
  Payload ID: 13732
  Gene Symbol: PTK7
  Gene Name: protein tyrosine kinase 7 (inactive)
  Uniprot ID: Q13308
  ENSP ID: ENSP00000418754
MGSFLSGEKRPSAPTVGSAMEKKEFPTPPGRVGPGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69099 - protein, 459 aa, Homo sapiens
  Payload ID: 13732
  Gene Symbol: PTK7
  Gene Name: protein tyrosine kinase 7 (inactive)
  ENSP ID: ENSP00000419037
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPGTHLRSSQFWALQAWESVHYWESV

SEQ ID NO: 69100 - protein, 25 aa, Homo sapiens
  Payload ID: 13732
  Gene Symbol: PTK7
  Gene Name: protein tyrosine kinase 7 (inactive)
  ENSP ID: ENSP00000419096
TEHGTEAIFVAAVGIRPSHHAAAQS

SEQ ID NO: 69101 - protein, 269 aa, Homo sapiens
  Payload ID: 13732
  Gene Symbol: PTK7
  Gene Name: protein tyrosine kinase 7 (inactive)
  ENSP ID: ENSP00000420165
FSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPAVPSWLKKPQDSQLEEGKPGYLDCLTQATPKPTVVWYRNQMLISEDSRFEVFKNGTLRINSVEVYDGTWYRCMSSTPAGSI

SEQ ID NO: 69102 - protein, 257 aa, Homo sapiens
  Payload ID: 13732
  Gene Symbol: PTK7
  Gene Name: protein tyrosine kinase 7 (inactive)
  ENSP ID: ENSP00000420186
MVARVSGLIVTLLSSSFPGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDV

SEQ ID NO: 69103 - protein, 157 aa, Homo sapiens
  Payload ID: 13732
  Gene Symbol: PTK7
  Gene Name: protein tyrosine kinase 7 (inactive)
  ENSP ID: ENSP00000420322
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPR

SEQ ID NO: 69104 - protein, 365 aa, Homo sapiens
  Payload ID: 13732
  Gene Symbol: PTK7
  Gene Name: protein tyrosine kinase 7 (inactive)
  ENSP ID: ENSP00000420765
  MOD_RES (1)..(1): Any amino acid
XEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 69105 - protein, 806 aa, Homo sapiens
  Payload ID: 13733
  Gene Symbol: PTPDC1
  Gene Name: protein tyrosine phosphatase domain containing 1
  Uniprot ID: A2A3K4
  ENSP ID: ENSP00000288976
MQVQDATRRPSAVRFLSSFLQGRRHSTSDPVLRLQQARRGSGLGSGSATKLLSSSSLQVMVAVSSVSHAEGNPTFPERKRNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 69106 - protein, 754 aa, Homo sapiens
  Payload ID: 13733
  Gene Symbol: PTPDC1
  Gene Name: protein tyrosine phosphatase domain containing 1
  Uniprot ID: A2A3K4
  ENSP ID: ENSP00000364509
MAAGVLPQNEQPYSTLVNNSECVANMKGNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 69107 - protein, 808 aa, Homo sapiens
  Payload ID: 13733
  Gene Symbol: PTPDC1
  Gene Name: protein tyrosine phosphatase domain containing 1
  ENSP ID: ENSP00000477817
MQVQDATRRPSAVRFLSSFLQGRRHSTSDPVLRLQQARRGSGLGSGSATKLLSSSSLQVMVAVSSVSHAEGNPTFPERKSKGNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 69108 - protein, 173 aa, Homo sapiens
  Payload ID: 13734
  Gene Symbol: PTP4A1
  Gene Name: protein tyrosine phosphatase type IVA, member 1
  Uniprot ID: Q93096
  ENSP ID: ENSP00000359685
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 69109 - protein, 44 aa, Homo sapiens
  Payload ID: 13734
  Gene Symbol: PTP4A1
  Gene Name: protein tyrosine phosphatase type IVA, member 1
  ENSP ID: ENSP00000462406
MIRPQSSMSKHIPQFCGVLGHTFMEFLKGSGDYCQAQHDLYADK

SEQ ID NO: 69110 - protein, 173 aa, Homo sapiens; identical to SEQ ID NO: 69108
  Payload ID: 13734
  Gene Symbol: PTP4A1
  Gene Name: protein tyrosine phosphatase type IVA, member 1
  Uniprot ID: Q93096
  ENSP ID: ENSP00000485687

SEQ ID NO: 69111 - protein, 148 aa, Homo sapiens
  Payload ID: 13734
  Gene Symbol: PTP4A1
  Gene Name: protein tyrosine phosphatase type IVA, member 1
  ENSP ID: ENSP00000487586
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRKRRGAFNSKQLLYLEKYRPKMRLRFKDSNGHRNNCCIQ

SEQ ID NO: 69112 - protein, 167 aa, Homo sapiens
  Payload ID: 13735
  Gene Symbol: PTP4A2
  Gene Name: protein tyrosine phosphatase type IVA, member 2
  Uniprot ID: Q12974
  ENSP ID: ENSP00000344909
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 69113 - protein, 136 aa, Homo sapiens
  Payload ID: 13735
  Gene Symbol: PTP4A2
  Gene Name: protein tyrosine phosphatase type IVA, member 2
  Uniprot ID: Q12974
  ENSP ID: ENSP00000409260
MNRPAPVEISYENMRFLITHNPTNATLNKFTEDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 69114 - protein, 66 aa, Homo sapiens
  Payload ID: 13735
  Gene Symbol: PTP4A2
  Gene Name: protein tyrosine phosphatase type IVA, member 2
  ENSP ID: ENSP00000433050
MNRPAPVEISYENMRFLITHNPTNATLNKFTEELKKYGVTTLVRVCDATYDKAPVEKEGIHVLMAE

SEQ ID NO: 69115 - protein, 22 aa, Homo sapiens
  Payload ID: 13735
  Gene Symbol: PTP4A2
  Gene Name: protein tyrosine phosphatase type IVA, member 2
  ENSP ID: ENSP00000433375
MNRPAPVEISYENMRFLITHNP

SEQ ID NO: 69116 - protein, 69 aa, Homo sapiens
  Payload ID: 13735
  Gene Symbol: PTP4A2
  Gene Name: protein tyrosine phosphatase type IVA, member 2
  ENSP ID: ENSP00000433800
MNRPAPVEISYENMRFLITHNPTNATLNKFTEELKKYGVTTLVRVCDATYDKAPVEKEGIHVLVHFREY

SEQ ID NO: 69117 - protein, 73 aa, Homo sapiens
  Payload ID: 13735
  Gene Symbol: PTP4A2
  Gene Name: protein tyrosine phosphatase type IVA, member 2
  ENSP ID: ENSP00000435941
MNRPAPVEISYENMRFLITHNPTNATLNKFTEELKKYGVTTLVRVCDATYDKAPVEKEGIHVLGTCAGCTCFD

SEQ ID NO: 69118 - protein, 63 aa, Homo sapiens
  Payload ID: 13735
  Gene Symbol: PTP4A2
  Gene Name: protein tyrosine phosphatase type IVA, member 2
  ENSP ID: ENSP00000437251
MNRPAPVEISYENMRFLITHNPTNATLNKFTEELKKYGVTTLVRVCDATYDKAPVEKEGIHVL

SEQ ID NO: 69119 - protein, 167 aa, Homo sapiens; identical to SEQ ID NO: 69112
  Payload ID: 13735
  Gene Symbol: PTP4A2
  Gene Name: protein tyrosine phosphatase type IVA, member 2
  Uniprot ID: Q12974
  ENSP ID: ENSP00000473259

SEQ ID NO: 69120 - protein, 142 aa, Homo sapiens
  Payload ID: 13735
  Gene Symbol: PTP4A2
  Gene Name: protein tyrosine phosphatase type IVA, member 2
  Uniprot ID: Q12974
  ENSP ID: ENSP00000473490
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRKRRGAFNSKQLLYLEKYRPKMRLRFRDTNGHCCVQ

SEQ ID NO: 69121 - protein, 69 aa, Homo sapiens; identical to SEQ ID NO: 69116
  Payload ID: 13735
  Gene Symbol: PTP4A2
  Gene Name: protein tyrosine phosphatase type IVA, member 2
  ENSP ID: ENSP00000486151

SEQ ID NO: 69122 - protein, 66 aa, Homo sapiens; identical to SEQ ID NO: 69114
  Payload ID: 13735
  Gene Symbol: PTP4A2
  Gene Name: protein tyrosine phosphatase type IVA, member 2
  ENSP ID: ENSP00000486246

SEQ ID NO: 69123 - protein, 148 aa, Homo sapiens
  Payload ID: 13736
  Gene Symbol: PTP4A3
  Gene Name: protein tyrosine phosphatase type IVA, member 3
  Uniprot ID: O75365
  ENSP ID: ENSP00000331730
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRKRRGAINSKQLTYLEKYRPKQRLRFKDPHTHKTRCCVM

SEQ ID NO: 69124 - protein, 173 aa, Homo sapiens
  Payload ID: 13736
  Gene Symbol: PTP4A3
  Gene Name: protein tyrosine phosphatase type IVA, member 3
  Uniprot ID: O75365
  ENSP ID: ENSP00000332274
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 69125 - protein, 70 aa, Homo sapiens
  Payload ID: 13736
  Gene Symbol: PTP4A3
  Gene Name: protein tyrosine phosphatase type IVA, member 3
  ENSP ID: ENSP00000428725
MARMNRPAPVEVSYKHMRFLITHNPTNATLSTFIEDLKKYGATTVVRVCEVTYDKTPLEKDGITVVDWPF

SEQ ID NO: 69126 - protein, 148 aa, Homo sapiens; identical to SEQ ID NO: 69123
  Payload ID: 13736
  Gene Symbol: PTP4A3
  Gene Name: protein tyrosine phosphatase type IVA, member 3
  Uniprot ID: O75365
  ENSP ID: ENSP00000428758

SEQ ID NO: 69127 - protein, 173 aa, Homo sapiens; identical to SEQ ID NO: 69124
  Payload ID: 13736
  Gene Symbol: PTP4A3
  Gene Name: protein tyrosine phosphatase type IVA, member 3
  Uniprot ID: O75365
  ENSP ID: ENSP00000428976

SEQ ID NO: 69128 - protein, 87 aa, Homo sapiens
  Payload ID: 13736
  Gene Symbol: PTP4A3
  Gene Name: protein tyrosine phosphatase type IVA, member 3
  ENSP ID: ENSP00000430332
MARMNRPAPVEVSYKHMRFLITHNPTNATLSTFIESGMKYEDAIQFIRQKRRGAINSKQLTYLEKYRPKQRLRFKDPHTHKTRCCVM

SEQ ID NO: 69129 - protein, 148 aa, Homo sapiens; identical to SEQ ID NO: 69123
  Payload ID: 13736
  Gene Symbol: PTP4A3
  Gene Name: protein tyrosine phosphatase type IVA, member 3
  Uniprot ID: O75365
  ENSP ID: ENSP00000481205

SEQ ID NO: 69130 - protein, 173 aa, Homo sapiens; identical to SEQ ID NO: 69124
  Payload ID: 13736
  Gene Symbol: PTP4A3
  Gene Name: protein tyrosine phosphatase type IVA, member 3
  Uniprot ID: O75365
  ENSP ID: ENSP00000484500

SEQ ID NO: 69131 - protein, 173 aa, Homo sapiens; identical to SEQ ID NO: 69124
  Payload ID: 13736
  Gene Symbol: PTP4A3
  Gene Name: protein tyrosine phosphatase type IVA, member 3
  Uniprot ID: O75365
  ENSP ID: ENSP00000487595

SEQ ID NO: 69132 - protein, 148 aa, Homo sapiens; identical to SEQ ID NO: 69123
  Payload ID: 13736
  Gene Symbol: PTP4A3
  Gene Name: protein tyrosine phosphatase type IVA, member 3
  Uniprot ID: O75365
  ENSP ID: ENSP00000487610

SEQ ID NO: 69133 - protein, 70 aa, Homo sapiens; identical to SEQ ID NO: 69125
  Payload ID: 13736
  Gene Symbol: PTP4A3
  Gene Name: protein tyrosine phosphatase type IVA, member 3
  ENSP ID: ENSP00000487861

SEQ ID NO: 69134 - protein, 137 aa, Homo sapiens
  Payload ID: 13737
  Gene Symbol: PTPMT1
  Gene Name: protein tyrosine phosphatase, mitochondrial 1
  Uniprot ID: Q8WUK0
  ENSP ID: ENSP00000325882
MAATALLEAGLARVLFYPTLLYTLFRGKVPGRAHRDWYHRIDPTVLLGALPLRSLTRQLVQDENVRGVITMNEEYETRFLCNSSQVHKWSPEEAVRAIAKIRSYIHIRPGQLDVLKEFHKQITARATKDGTFVISKT

SEQ ID NO: 69135 - protein, 201 aa, Homo sapiens
  Payload ID: 13737
  Gene Symbol: PTPMT1
  Gene Name: protein tyrosine phosphatase, mitochondrial 1
  Uniprot ID: Q8WUK0
  ENSP ID: ENSP00000325958
MAATALLEAGLARVLFYPTLLYTLFRGKVPGRAHRDWYHRIDPTVLLGALPLRSLTRQLVQDENVRGVITMNEEYETRFLCNSSQEWKRLGVEQLRLSTVDMTGIPTLDNLQKGVQFALKYQSLGQCVYVHCKAGRSRSATMVAAYLIQVHKWSPEEAVRAIAKIRSYIHIRPGQLDVLKEFHKQITARATKDGTFVISKT

SEQ ID NO: 69136 - protein, 151 aa, Homo sapiens
  Payload ID: 13737
  Gene Symbol: PTPMT1
  Gene Name: protein tyrosine phosphatase, mitochondrial 1
  Uniprot ID: Q8WUK0
  ENSP ID: ENSP00000410272
MAATALLEAGLARVLFYPTLLYTLFRGKVPGRAHRDWYHRIDPTVLLGALPLRSLTRQVSRAGEPGPLPRPRRSVPVGPLGSPPSLLSHLFASAAGTGRERARGDHHERGVRDEVPVQLFTGAQMESRGGCKSHRQDPVIHPHQAWPAGCS

SEQ ID NO: 69137 - protein, 168 aa, Homo sapiens
  Payload ID: 13737
  Gene Symbol: PTPMT1
  Gene Name: protein tyrosine phosphatase, mitochondrial 1
  ENSP ID: ENSP00000436160
MAATALLEAGLARVLFYPTLLYTLFRGKVPGRAHRDWYHRIDPTVLLGALPLRSLTRQVSRAGEPGPLPRPRRSVPVGPLGSPPSLLSHLFASAAGTGRERARGDHHERGVRDEVPVQLFTGVEETRSRAAAAQHSRHDWDPHLGQPPEGSPICSQVPVAGPVCLRAL

SEQ ID NO: 69138 - protein, 435 aa, Homo sapiens
  Payload ID: 13738
  Gene Symbol: PTPN1
  Gene Name: protein tyrosine phosphatase, non-receptor type 1
  Uniprot ID: P18031
  ENSP ID: ENSP00000360683
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 69139 - protein, 362 aa, Homo sapiens
  Payload ID: 13738
  Gene Symbol: PTPN1
  Gene Name: protein tyrosine phosphatase, non-receptor type 1
  ENSP ID: ENSP00000437732
MEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 69140 - protein, 593 aa, Homo sapiens [sequence omitted]

SEQ ID NO: 69141 - protein, 460 aa, Homo sapiens
  Payload ID: 13739
  Gene Symbol: PTPN11
  Gene Name: protein tyrosine phosphatase, non-receptor type 11
  Uniprot ID: Q06124
  ENSP ID: ENSP00000376376
MTSRRWFHPNITGVEAENLLLTRGVDGSFLARPSKSNPGDFTLSVRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPLNTTRINAAEIESRVRELSKLAETTDKVKQGFWEEFETLQQQECKLLYSRKEGQRQENKNKNRYKNILPFDHTRVVLHDGDPNEPVSDYINANIIMPEFETKCNNSKPKKSYIATQGCLQNTVNDFWRMVFQENSRVIVMTTKEVERGKSKCVKYWPDEYALKEYGVMRVRNVKESAAHDYTLRELKLSKVGQGNTERTVWQYHFRTWPDHGVPSDPGGVLDFLEEVHHKQESIMDAGPVVVHCR

SEQ ID NO: 69142 - protein, 108 aa, Homo sapiens
  Payload ID: 13739
  Gene Symbol: PTPN11
  Gene Name: protein tyrosine phosphatase, non-receptor type 11
  ENSP ID: ENSP00000437013
  MOD_RES (1)..(1): Any amino acid
XKGESNDGKSKVTHVMIRCQELKYDVGGGERFDSLTDLVEHYKKNPMVETLGTVLQLKQPLNTTRINAAEIESRVRELSKLAETTDKVKQGFWEEFEFAENDGFQLHP

SEQ ID NO: 69143 - protein, 196 aa, Homo sapiens
  Payload ID: 13739
  Gene Symbol: PTPN11
  Gene Name: protein tyrosine phosphatase, non-receptor type 11
  ENSP ID: ENSP00000489541
TVNDFWRMVFQENSRVIVMTTKEVERGKSKCVKYWPDEYALKEYGVMRVRNVKESAAHDYTLRELKLSKVGQFFLALLQGNTERTVWQYHFRTWPDHGVPSDPGGVLDFLEEVHHKQESIMDAGPVVVHCSAGIGRTGTFIVIDILIDIIREKGVDCDIDVPKTIQMVRSQRSGMVQTEAQYRFIYMAVQHYIETL

SEQ ID NO: 69144 - protein, 597 aa, Homo sapiens
  Payload ID: 13739
  Gene Symbol: PTPN11
  Gene Name: protein tyrosine phosphatase, non-receptor type 11
  ENSP ID: ENSP00000489597
MTSRRWFHPNITGVEAENLLLTRGVDGSFLARPSKSNPGDFTLSVRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPLNTTRINAAEIESRVRELSKLAETTDKVKQGFWEEFETLQQQECKLLYSRKEGQRQENKNKNRYKNILPFDHTRVVLHDGDPNEPVSDYINANIIMPEFETKCNNSKPKKSYIATQGCLQNTVNDFWRMVFQENSRVIVMTTKEVERGKSKCVKYWPDEYALKEYGVMRVRNVKESAAHDYTLRELKLSKVGQALLQGNTERTVWQYHFRTWPDHGVPSDPGGVLDFLEEVHHKQESIMDAGPVVVHCSAGIGRTGTFIVIDILIDIIREKGVDCDIDVPKTIQMVRSQRSGMVQTEAQYRFIYMAVQHYIETLQRRIEEEQKSKRKGHEYTNIKYSLADQTSGDQSPLPPCTPTPPCAEMREDSARVYENVGLMQQQKSFR

SEQ ID NO: 69145 - protein, 780 aa, Homo sapiens
  Payload ID: 13740
  Gene Symbol: PTPN12
  Gene Name: protein tyrosine phosphatase, non-receptor type 12
  Uniprot ID: Q05209
  ENSP ID: ENSP00000248594
MEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 69146 - protein, 234 aa, Homo sapiens
  Payload ID: 13740
  Gene Symbol: PTPN12
  Gene Name: protein tyrosine phosphatase, non-receptor type 12
  ENSP ID: ENSP00000385079
NSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDTPVRSEWSELQSQERSEQKKSEGLITSENEKCDHPAGGIHYEMCIECPPTFSDKREQISE

SEQ ID NO: 69147 - protein, 661 aa, Homo sapiens
  Payload ID: 13740
  Gene Symbol: PTPN12
  Gene Name: protein tyrosine phosphatase, non-receptor type 12
  Uniprot ID: Q05209
  ENSP ID: ENSP00000392429
MIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 69148 - protein, 86 aa, Homo sapiens
  Payload ID: 13740
  Gene Symbol: PTPN12
  Gene Name: protein tyrosine phosphatase, non-receptor type 12
  ENSP ID: ENSP00000392526
MIWEYNVVIIVMACREFEMGRKKCERYWPLYGEDPITFAPFKISCEDEQARTDYFIRTLLLEFQNESRRLYQFHYVNWPDHDVPSS

SEQ ID NO: 69149 - protein, 113 aa, Homo sapiens
  Payload ID: 13740
  Gene Symbol: PTPN12
  Gene Name: protein tyrosine phosphatase, non-receptor type 12
  ENSP ID: ENSP00000397364
MIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCS

SEQ ID NO: 69150 - protein, 650 aa, Homo sapiens
  Payload ID: 13740
  Gene Symbol: PTPN12
  Gene Name: protein tyrosine phosphatase, non-receptor type 12
  Uniprot ID: Q05209
  ENSP ID: ENSP00000397991
MACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 69151 - protein, 45 aa, Homo sapiens
  Payload ID: 13740
  Gene Symbol: PTPN12
  Gene Name: protein tyrosine phosphatase, non-receptor type 12
  ENSP ID: ENSP00000404050
MIWEYNVVIIVMACREFEMGRKKCERYWPLYGEDPITFAPFKISC

SEQ ID NO: 69152 - protein, 17 aa, Homo sapiens
  Payload ID: 13740
  Gene Symbol: PTPN12
  Gene Name: protein tyrosine phosphatase, non-receptor type 12
  ENSP ID: ENSP00000413449
MIWEYNVVIIVMACREF

SEQ ID NO: 69153 - protein, 43 aa, Homo sapiens
  Payload ID: 13740
  Gene Symbol: PTPN12
  Gene Name: protein tyrosine phosphatase, non-receptor type 12
  ENSP ID: ENSP00000428735
  MOD_RES (1)..(1): Any amino acid
XVEILRKFIQRVQAMKSPDHNGEDNFARDFMMELCRPGWSAVV

SEQ ID NO: 69154 - protein, 214 aa, Homo sapiens
  Payload ID: 13740
  Gene Symbol: PTPN12
  Gene Name: protein tyrosine phosphatase, non-receptor type 12
  ENSP ID: ENSP00000430726
  MOD_RES (1)..(1): Any amino acid
XSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGREDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHS

SEQ ID NO: 69155 - protein, 2294 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENSP ID: ENSP00000322675
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 69156 - protein, 2490 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENSP ID: ENSP00000394794
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTVLFDKGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 69157 - protein, 2485 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENSP ID: ENSP00000407249
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 69158 - protein, 2466 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENSP ID: ENSP00000408368
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 69159 - protein, 139 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  ENSP ID: ENSP00000422835
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDV

SEQ ID NO: 69160 - protein, 227 aa, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  ENSP ID: ENSP00000423531
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGVFPKPSPLSLLLGTLLPSVSRESMLVSLPDFPKTWTLLVFLLFWI

SEQ ID NO: 69161 - protein, 2490 aa, Homo sapiens; identical to SEQ ID NO: 69156
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENSP ID: ENSP00000426626

SEQ ID NO: 69162 - protein, 1187 aa, Homo sapiens
  Payload ID: 13742
  Gene Symbol: PTPN14
  Gene Name: protein tyrosine phosphatase, non-receptor type 14
  Uniprot ID: Q15678
  ENSP ID: ENSP00000355923
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEEEGGRTKSHRYWPKLGSKHSSATYGKFKVTTKFRTDSVCYATTGLKVKHLLSGQERTVWHLQYTDWPDHGCPEDVQGFLSYLEEIQSVRRHTNSMLEGTKNRHPPIVVHCSAGVGRTGVLILSELMIYCLEHNEKVEVPMMLRLLREQRMFMIQTIAQYKFVYQVLIQFLQNSRLI

SEQ ID NO: 69163 - protein, 211 aa, Homo sapiens
  Payload ID: 13742
  Gene Symbol: PTPN14
  Gene Name: protein tyrosine phosphatase, non-receptor type 14
  ENSP ID: ENSP00000443330
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHRTIMETVYTLAFSLWGFS

SEQ ID NO: 69164 - protein, 460 aa, Homo sapiens
  Payload ID: 13743
  Gene Symbol: PTPN18
  Gene Name: protein tyrosine phosphatase, non-receptor type 18 (brain-derived)
  Uniprot ID: Q99952
  ENSP ID: ENSP00000175756
MSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 69165 - protein, 353 aa, Homo sapiens
  Payload ID: 13743
  Gene Symbol: PTPN18
  Gene Name: protein tyrosine phosphatase, non-receptor type 18 (brain-derived)
  Uniprot ID: Q99952
  ENSP ID: ENSP00000310092
MSRSLDSARSFLERLEARGGREGAVLAGEFSKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 69166 - protein, 269 aa, Homo sapiens
  Payload ID: 13743
  Gene Symbol: PTPN18
  Gene Name: protein tyrosine phosphatase, non-receptor type 18 (brain-derived)
  ENSP ID: ENSP00000387031
  MOD_RES (1)..(1): Any amino acid
XDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRVSLDL

SEQ ID NO: 69167 - protein, 48 aa, Homo sapiens
  Payload ID: 13743
  Gene Symbol: PTPN18
  Gene Name: protein tyrosine phosphatase, non-receptor type 18 (brain-derived)
  ENSP ID: ENSP00000411750
MSRSLDSARSFLERLEARGGREGAVLAGEFSEGRGCSRAKRNTEAVAW

SEQ ID NO: 69168 - protein, 415 aa, Homo sapiens
  Payload ID: 13744
  Gene Symbol: PTPN2
  Gene Name: protein tyrosine phosphatase, non-receptor type 2
  Uniprot ID: P17706
  ENSP ID: ENSP00000311857
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 69169 - protein, 387 aa, Homo sapiens
  Payload ID: 13744
  Gene Symbol: PTPN2
  Gene Name: protein tyrosine phosphatase, non-receptor type 2
  Uniprot ID: P17706
  ENSP ID: ENSP00000320298
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 69170 - protein, 353 aa, Homo sapiens
  Payload ID: 13744
  Gene Symbol: PTPN2
  Gene Name: protein tyrosine phosphatase, non-receptor type 2
  Uniprot ID: P17706
  ENSP ID: ENSP00000320546
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSERPRLTDT

SEQ ID NO: 69171 - protein, 151 aa, Homo sapiens
  Payload ID: 13744
  Gene Symbol: PTPN2
  Gene Name: protein tyrosine phosphatase, non-receptor type 2
  ENSP ID: ENSP00000464719
  MOD_RES (1)..(1): Any amino acid
XKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRHRLLLIHQISAVKNFSYFEFS

SEQ ID NO: 69172 - protein, 112 aa, Homo sapiens
  Payload ID: 13744
  Gene Symbol: PTPN2
  Gene Name: protein tyrosine phosphatase, non-receptor type 2
  ENSP ID: ENSP00000464937
  MOD_RES (1)..(1): Any amino acid
XKRWKELSKEDLSPAFDHSPNKIMTEKYNGNRIGLEEEKLTGDRCTGLSSKMQDTMEENSESALRKRIREDRKATTAQKVQQMKQRLNENERKRKSFPHFKKKSKQRNKSFS

SEQ ID NO: 69173 - protein, 68 aa, Homo sapiens
  Payload ID: 13744
  Gene Symbol: PTPN2
  Gene Name: protein tyrosine phosphatase, non-receptor type 2
  ENSP ID: ENSP00000466206
MVWQQKTKAVVMLNRIVEKESVKCAQYWPTDDQEMLFKETGFSVKLLSEDVKSYYTVHLLQLENINVR

SEQ ID NO: 69174 - protein, 410 aa, Homo sapiens
  Payload ID: 13744
  Gene Symbol: PTPN2
  Gene Name: protein tyrosine phosphatase, non-receptor type 2
  Uniprot ID: P17706
  ENSP ID: ENSP00000466936
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINYIENLWITLYLKLLMLDVKRSLKSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 69175 - protein, 146 aa, Homo sapiens
  Payload ID: 13744
  Gene Symbol: PTPN2
  Gene Name: protein tyrosine phosphatase, non-receptor type 2
  ENSP ID: ENSP00000467043
  MOD_RES (1)..(1): Any amino acid
XEEAQRSYILTQGPLPNTCCHFWLMVWQQKTKAVVMLNRIVEKESKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 69176 - protein, 386 aa, Homo sapiens
  Payload ID: 13744
  Gene Symbol: PTPN2
  Gene Name: protein tyrosine phosphatase, non-receptor type 2
  ENSP ID: ENSP00000467823
MYGKDGKGTNWMDQGDMECRMQEIDDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 69177 - protein, 42 aa, Homo sapiens
  Payload ID: 13744
  Gene Symbol: PTPN2
  Gene Name: protein tyrosine phosphatase, non-receptor type 2
  ENSP ID: ENSP00000468012
MPTTIEREFEELDTQRRWQPLYLMITVVLNCKMLRMIILMPV

SEQ ID NO: 69178 - protein, 165 aa, Homo sapiens
  Payload ID: 13744
  Gene Symbol: PTPN2
  Gene Name: protein tyrosine phosphatase, non-receptor type 2
  ENSP ID: ENSP00000468155
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENIN

SEQ ID NO: 69179 - protein, 42 aa, Homo sapiens; identical to SEQ ID NO: 69177
  Payload ID: 13744
  Gene Symbol: PTPN2
  Gene Name: protein tyrosine phosphatase, non-receptor type 2
  ENSP ID: ENSP00000468408

SEQ ID NO: 69180 - protein, 339 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000363335
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69181 - protein, 420 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000363459
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69182 - protein, 64 aa, Homo sapiens
  Payload ID: 13745
  Gene Symbol: PTPN20
  Gene Name: protein tyrosine phosphatase, non-receptor type 20
  ENSP ID: ENSP00000363462
MWTARGPFRRDRWSSEDEEAAGPSQALSPLLSVQHHGYSGPNERTTFWHGSNEGAVSLLLRYCA

SEQ ID NO: 69183 - protein, 226 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000363466
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 69184 - protein, 339 aa, Homo sapiens; identical to SEQ ID NO: 69180
  Payload ID: 13745
  Gene Symbol: PTPN20
  Gene Name: protein tyrosine phosphatase, non-receptor type 20
  Uniprot ID: Q4JDL3
  ENSP ID: ENSP00000379071

SEQ ID NO: 69185 - protein, 64 aa, Homo sapiens; identical to SEQ ID NO: 69182
  Payload ID: 13745
  Gene Symbol: PTPN20
  Gene Name: protein tyrosine phosphatase, non-receptor type 20
  ENSP ID: ENSP00000379072

SEQ ID NO: 69186 - protein, 145 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000379075
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 69187 - protein, 228 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000379077
MIDDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69188 - protein, 126 aa, Homo sapiens
  Payload ID: 13745
  Gene Symbol: PTPN20
  Gene Name: protein tyrosine phosphatase, non-receptor type 20
  ENSP ID: ENSP00000396009
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERT

SEQ ID NO: 69189 - protein, 62 aa, Homo sapiens
  Payload ID: 13745
  Gene Symbol: PTPN20
  Gene Name: protein tyrosine phosphatase, non-receptor type 20
  ENSP ID: ENSP00000403444
MWTARGPFRRDRWSSEDEEAAGPSQALSPLLSGLEHLRILVSVGGPGTNSLQIQRDNSSTSI

SEQ ID NO: 69190 - protein, 206 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000420995
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMFNIMDIVAQMREQRSGMVQTKEQYHFCYDIVLEVLRKLLTLD

SEQ ID NO: 69191 - protein, 145 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000421404
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSVQHHGYSGPNERTTFWHGSNEGAVSLLLRYCA

SEQ ID NO: 69192 - protein, 104 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000421453
MWTARGPFRRDRWSSEDEEAAGPSQALSPLLSDTRKIVSEGELDQLAQIRPLIFNFHEQTAIKDCLKILEEKTAAYDIMQEFMMIQHAFLLEKARTTSMLVILE

SEQ ID NO: 69193 - protein, 339 aa, Homo sapiens; identical to SEQ ID NO: 69180
  Payload ID: 13745
  Gene Symbol: PTPN20
  Gene Name: protein tyrosine phosphatase, non-receptor type 20
  Uniprot ID: Q4JDL3
  ENSP ID: ENSP00000421921

SEQ ID NO: 69194 - protein, 68 aa, Homo sapiens
  Payload ID: 13745
  Gene Symbol: PTPN20
  Gene Name: protein tyrosine phosphatase, non-receptor type 20
  ENSP ID: ENSP00000422384
MSSPRDFRAEPVNDYEGNDSEAEDLNFRETLPSSSQENTPRSKVFENKVNSEKVKLSLRNFPHNDYED

SEQ ID NO: 69195 - protein, 197 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000422839
MWTARGPFRRDRWSSEDEEAAGPSQALSPLLSDTRKIVSEGELDQLAQIRPLIFNFHEQTAIKDCLKILEEKTAAYDIMQEFMTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69196 - protein, 145 aa, Homo sapiens; identical to SEQ ID NO: 69186
  Payload ID: 13745
  Gene Symbol: PTPN20
  Gene Name: protein tyrosine phosphatase, non-receptor type 20
  Uniprot ID: Q4JDL3
  ENSP ID: ENSP00000423819

SEQ ID NO: 69197 - protein, 411 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000424283
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69198 - protein, 145 aa, Homo sapiens; identical to SEQ ID NO: 69186
  Payload ID: 13745
  Gene Symbol: PTPN20
  Gene Name: protein tyrosine phosphatase, non-receptor type 20
  Uniprot ID: Q4JDL3
  ENSP ID: ENSP00000424491

SEQ ID NO: 69199 - protein, 226 aa, Homo sapiens; identical to SEQ ID NO: 69183
  Payload ID: 13745
  Gene Symbol: PTPN20
  Gene Name: protein tyrosine phosphatase, non-receptor type 20
  Uniprot ID: Q4JDL3
  ENSP ID: ENSP00000425012

SEQ ID NO: 69200 - protein, 217 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000425362
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 69201 - protein, 269 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000425912
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 69202 - protein, 339 aa, Homo sapiens; identical to SEQ ID NO: 69180
  Payload ID: 13745
  Gene Symbol: PTPN20
  Gene Name: protein tyrosine phosphatase, non-receptor type 20
  Uniprot ID: Q4JDL3
  ENSP ID: ENSP00000426355

SEQ ID NO: 69203 - protein, 62 aa, Homo sapiens
  Payload ID: 13745
  Gene Symbol: PTPN20
  Gene Name: protein tyrosine phosphatase, non-receptor type 20
  ENSP ID: ENSP00000426681
MWTARGPFRRDRWSSEDEEAAGPSQALSPLLSVFHSPVEGHCVASRFWQLWIKVLQIFTNFV

SEQ ID NO: 69204 - protein, 136 aa, Homo sapiens
  Payload ID: 13745
  Gene Symbol: PTPN20
  Gene Name: protein tyrosine phosphatase, non-receptor type 20
  Uniprot ID: Q4JDL3
  ENSP ID: ENSP00000427676
MIVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSVQHHGYSGPNERTTFWHGSNEGAVSLLLRYCA

SEQ ID NO: 69205 - protein, 64 aa, Homo sapiens; identical to SEQ ID NO: 69182
  Payload ID: 13745
  Gene Symbol: PTPN20
  Gene Name: protein tyrosine phosphatase, non-receptor type 20
  ENSP ID: ENSP00000477675

SEQ ID NO: 69206 - protein, 64 aa, Homo sapiens; identical to SEQ ID NO: 69182
  Payload ID: 13745
  Gene Symbol: PTPN20
  Gene Name: protein tyrosine phosphatase, non-receptor type 20
  ENSP ID: ENSP00000479990

SEQ ID NO: 69207 - protein, 64 aa, Homo sapiens; identical to SEQ ID NO: 69182
  Payload ID: 13745
  Gene Symbol: PTPN20
  Gene Name: protein tyrosine phosphatase, non-receptor type 20
  ENSP ID: ENSP00000480504

SEQ ID NO: 69208 - protein, 1174 aa, Homo sapiens [sequence omitted]

SEQ ID NO: 69209 - protein, 61 aa, Homo sapiens
  Payload ID: 13746
  Gene Symbol: PTPN21
  Gene Name: protein tyrosine phosphatase, non-receptor type 21
  ENSP ID: ENSP00000443951
MPLPFGLKLKRTRRYTVSSKSCLVARIQLLNNEFVEFTLSVESTGQESLEAVAQRLELREG

SEQ ID NO: 69210 - protein, 128 aa, Homo sapiens
  Payload ID: 13746
  Gene Symbol: PTPN21
  Gene Name: protein tyrosine phosphatase, non-receptor type 21
  ENSP ID: ENSP00000450847
ATTGLKMKHLLTGQERTVWHLQYTDWPEHGCPEDLKGFLSYLEEIQSVRRHTNSTSDPQSPNPPLLVHCSAGHPESAGHAEATENDAGADSLPVHICVQSPHPVPEKLQAHLSSHNFLRGQSCEAFTA

SEQ ID NO: 69211 - protein, 195 aa, Homo sapiens
  Payload ID: 13746
  Gene Symbol: PTPN21
  Gene Name: protein tyrosine phosphatase, non-receptor type 21
  ENSP ID: ENSP00000451401
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKY

SEQ ID NO: 69212 - protein, 1174 aa, Homo sapiens [sequence omitted]

SEQ ID NO: 69213 - protein, 807 aa, Homo sapiens
  Payload ID: 13747
  Gene Symbol: PTPN22
  Gene Name: protein tyrosine phosphatase, non-receptor type 22 (lymphoid)
  ENSP ID: ENSP00000352833
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 69214 - protein, 795 aa, Homo sapiens
  Payload ID: 13747
  Gene Symbol: PTPN22
  Gene Name: protein tyrosine phosphatase, non-receptor type 22 (lymphoid)
  ENSP ID: ENSP00000388229
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGMCVILLKS

SEQ ID NO: 69215 - protein, 135 aa, Homo sapiens
  Payload ID: 13747
  Gene Symbol: PTPN22
  Gene Name: protein tyrosine phosphatase, non-receptor type 22 (lymphoid)
  ENSP ID: ENSP00000431249
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLCWLWKDWCYLCY

SEQ ID NO: 69216 - protein, 668 aa, Homo sapiens
  Payload ID: 13747
  Gene Symbol: PTPN22
  Gene Name: protein tyrosine phosphatase, non-receptor type 22 (lymphoid)
  ENSP ID: ENSP00000432674
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGMCVILLKS

SEQ ID NO: 69217 - protein, 179 aa, Homo sapiens
  Payload ID: 13747
  Gene Symbol: PTPN22
  Gene Name: protein tyrosine phosphatase, non-receptor type 22 (lymphoid)
  Uniprot ID: Q9Y2R2
  ENSP ID: ENSP00000433141
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSVSVILAHQTSLQNLFSQITPAHF

SEQ ID NO: 69218 - protein, 92 aa, Homo sapiens
  Payload ID: 13747
  Gene Symbol: PTPN22
  Gene Name: protein tyrosine phosphatase, non-receptor type 22 (lymphoid)
  ENSP ID: ENSP00000434932
MDQREILQKFLDEAQSKKITKEEFANEFLGLALSPRLECRGLIIAHCRLDFLDSSDPPASASQSAEITTMSHHTWPEKAFWTSLNRSNLLLS

SEQ ID NO: 69219 - protein, 752 aa, Homo sapiens
  Payload ID: 13747
  Gene Symbol: PTPN22
  Gene Name: protein tyrosine phosphatase, non-receptor type 22 (lymphoid)
  ENSP ID: ENSP00000435176
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGSQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 69220 - protein, 783 aa, Homo sapiens
  Payload ID: 13747
  Gene Symbol: PTPN22
  Gene Name: protein tyrosine phosphatase, non-receptor type 22 (lymphoid)
  ENSP ID: ENSP00000439372
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 69221 - protein, 1636 aa, Homo sapiens
  Payload ID: 13748
  Gene Symbol: PTPN23
  Gene Name: protein tyrosine phosphatase, non-receptor type 23
  Uniprot ID: Q9H3S7
  ENSP ID: ENSP00000265562
MEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 69222 - protein, 169 aa, Homo sapiens
  Payload ID: 13748
  Gene Symbol: PTPN23
  Gene Name: protein tyrosine phosphatase, non-receptor type 23
  ENSP ID: ENSP00000396328
MEAVPRMPMIWLDLKEAGDFHFQPAVKKNAVRVPRDFEGCSVLRKYLGQLHYLQSRVPMGSGQEAAVPVTWTEIFSGKSVAHEDIKYEQACILYNLGALHSMLGAMDKRVSEECAAGAFAYLREHFPQAYSVDMSRQILTLNVNLMLGQAQECLLEKSMLDNRKSFLVA

SEQ ID NO: 69223 - protein, 64 aa, Homo sapiens
  Payload ID: 13748
  Gene Symbol: PTPN23
  Gene Name: protein tyrosine phosphatase, non-receptor type 23
  ENSP ID: ENSP00000473266
MEAVPRMPMIWLDLKEAGDFHFQPAVKKFVLKNYGENPEAYNEELKKLELLRQDRDLLRQVCGP

SEQ ID NO: 69224 - protein, 839 aa, Homo sapiens
  Payload ID: 13749
  Gene Symbol: PTPN3
  Gene Name: protein tyrosine phosphatase, non-receptor type 3
  ENSP ID: ENSP00000262539
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQVSRSLRGTVEGQVLNQRPLSSQVVTLLGVHSVCTWQACQPGKNTQ

SEQ ID NO: 69225 - protein, 913 aa, Homo sapiens
  Payload ID: 13749
  Gene Symbol: PTPN3
  Gene Name: protein tyrosine phosphatase, non-receptor type 3
  Uniprot ID: P26045
  ENSP ID: ENSP00000363667
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 69226 - protein, 737 aa, Homo sapiens
  Payload ID: 13749
  Gene Symbol: PTPN3
  Gene Name: protein tyrosine phosphatase, non-receptor type 3
  Uniprot ID: P26045
  ENSP ID: ENSP00000395384
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 69227 - protein, 782 aa, Homo sapiens
  Payload ID: 13749
  Gene Symbol: PTPN3
  Gene Name: protein tyrosine phosphatase, non-receptor type 3
  Uniprot ID: P26045
  ENSP ID: ENSP00000416654
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 69228 - protein, 926 aa, Homo sapiens
  Payload ID: 13750
  Gene Symbol: PTPN4
  Gene Name: protein tyrosine phosphatase, non-receptor type 4 (megakaryocyte)
  Uniprot ID: P29074
  ENSP ID: ENSP00000263708
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 69229 - protein, 197 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000387457
RNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPVSYLNVSNKSCFQEYVLIL

SEQ ID NO: 69230 - protein, 219 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000394706
  MOD_RES (1)..(1): Any amino acid
XSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPFCFLYFIFQSQYRFVCEAILKVYEEGFVKPLTTSTNK

SEQ ID NO: 69231 - protein, 135 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000395603
  MOD_RES (1)..(1): Any amino acid
XELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELVSTDLIIIDINEAF

SEQ ID NO: 69232 - protein, 75 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000405763
MTSRFRLPAGRTYNVRASELARDRQHTEVVCNILLLDNTVQAFKVNKHDQGQVLLDVVFKHLDLTEQDYFGLQLA

SEQ ID NO: 69233 - protein, 121 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000411364
RWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHMIRVTMKL

SEQ ID NO: 69234 - protein, 161 aa, Homo sapiens
  Payload ID: 13750
  Gene Symbol: PTPN4
  Gene Name: protein tyrosine phosphatase, non-receptor type 4 (megakaryocyte)
  ENSP ID: ENSP00000438445
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKKLLLLILGGSPYSLNFRVKFFVSDPNKLQEEYTRYQYFLQIKQDILTGRLPCPSNTAALLASFAV

SEQ ID NO: 69235 - protein, 565 aa, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENSP ID: ENSP00000351342
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 69236 - protein, 171 aa, Homo sapiens
  Payload ID: 13751
  Gene Symbol: PTPN5
  Gene Name: protein tyrosine phosphatase, non-receptor type 5 (striatum-enriched)
  ENSP ID: ENSP00000379469
MWPRWKGEGVPLSVFFLCSSSFHLISISGLVCELKEFTHTWGGPLSPRQSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 69237 - protein, 541 aa, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENSP ID: ENSP00000379471
MCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 69238 - protein, 533 aa, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENSP ID: ENSP00000379473
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 69239 - protein, 369 aa, Homo sapiens
  Payload ID: 13751
  Gene Symbol: PTPN5
  Gene Name: protein tyrosine phosphatase, non-receptor type 5 (striatum-enriched)
  ENSP ID: ENSP00000435056
MEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 69240 - protein, 595 aa, Homo sapiens
  Payload ID: 13752
  Gene Symbol: PTPN6
  Gene Name: protein tyrosine phosphatase, non-receptor type 6
  Uniprot ID: P29350
  ENSP ID: ENSP00000326010
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 69241 - protein, 597 aa, Homo sapiens
  Payload ID: 13752
  Gene Symbol: PTPN6
  Gene Name: protein tyrosine phosphatase, non-receptor type 6
  Uniprot ID: P29350
  ENSP ID: ENSP00000382376
MLSRGWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 69242 - protein, 624 aa, Homo sapiens
  Payload ID: 13752
  Gene Symbol: PTPN6
  Gene Name: protein tyrosine phosphatase, non-receptor type 6
  Uniprot ID: P29350
  ENSP ID: ENSP00000391592
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKSLESSAGTVAASPVRRGGQRGLPVPGPPVLSPDLHQLPVLAPLHPAADTRRMCMRTCTLRTRGRRK

SEQ ID NO: 69243 - protein, 165 aa, Homo sapiens
  Payload ID: 13752
  Gene Symbol: PTPN6
  Gene Name: protein tyrosine phosphatase, non-receptor type 6
  ENSP ID: ENSP00000438740
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVT

SEQ ID NO: 69244 - protein, 144 aa, Homo sapiens
  Payload ID: 13752
  Gene Symbol: PTPN6
  Gene Name: protein tyrosine phosphatase, non-receptor type 6
  ENSP ID: ENSP00000440114
MVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFD

SEQ ID NO: 69245 - protein, 60 aa, Homo sapiens
  Payload ID: 13752
  Gene Symbol: PTPN6
  Gene Name: protein tyrosine phosphatase, non-receptor type 6
  ENSP ID: ENSP00000441044
MVRWFHRDLSGLDAETLLKGRGVHGSFLARPSRKNQGDFSLSVRTQGISMTCMEGRSLRL

SEQ ID NO: 69246 - protein, 130 aa, Homo sapiens
  Payload ID: 13752
  Gene Symbol: PTPN6
  Gene Name: protein tyrosine phosphatase, non-receptor type 6
  ENSP ID: ENSP00000443393
MLSRGCTSSFPAPPSSPEAPRMVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSER

SEQ ID NO: 69247 - protein, 58 aa, Homo sapiens
  Payload ID: 13752
  Gene Symbol: PTPN6
  Gene Name: protein tyrosine phosphatase, non-receptor type 6
  ENSP ID: ENSP00000444805
MLSRGWFHRDLSGLDAETLLKGRGVHGSFLARPSRKNQGDFSLSVRTATAPSSTSSTR

SEQ ID NO: 69248 - protein, 150 aa, Homo sapiens
  Payload ID: 13752
  Gene Symbol: PTPN6
  Gene Name: protein tyrosine phosphatase, non-receptor type 6
  ENSP ID: ENSP00000445646
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAPRSGSPTSRSCARVDATQWVVWRP

SEQ ID NO: 69249 - protein, 56 aa, Homo sapiens
  Payload ID: 13752
  Gene Symbol: PTPN6
  Gene Name: protein tyrosine phosphatase, non-receptor type 6
  ENSP ID: ENSP00000446345
MVRWFHRDLSGLDAETLLKGRGVHGSFLARPSRKNQGDFSLSVRTATAPSSTSSTR

SEQ ID NO: 69250 - protein, 72 aa, Homo sapiens
  Payload ID: 13752
  Gene Symbol: PTPN6
  Gene Name: protein tyrosine phosphatase, non-receptor type 6
  ENSP ID: ENSP00000476175
MVRWFHRDLSGLDAETLLKGRGVHGSFLARPSRKNQGDFSLSVRTSADPCPPASTPAPTGLTAWCPAGWGIR

SEQ ID NO: 69251 - protein, 465 aa, Homo sapiens
  Payload ID: 13753
  Gene Symbol: PTPN7
  Gene Name: protein tyrosine phosphatase, non-receptor type 7
  Uniprot ID: P35236
  ENSP ID: ENSP00000309116
MVGKAWPLTHSQGTGPWAPEGHRREAADPWWQRQQAQEGRMQLGCAWVAARRGGGRKLASWSLLSPQRQTDRQTDSWQEAAWGPQLLQQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 69252 - protein, 399 aa, Homo sapiens
  Payload ID: 13753
  Gene Symbol: PTPN7
  Gene Name: protein tyrosine phosphatase, non-receptor type 7
  Uniprot ID: P35236
  ENSP ID: ENSP00000356248
MGASFWPIRQAREQQRRALSFRQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 69253 - protein, 153 aa, Homo sapiens
  Payload ID: 13753
  Gene Symbol: PTPN7
  Gene Name: protein tyrosine phosphatase, non-receptor type 7
  ENSP ID: ENSP00000406042
MVQAHGGRSRAQPLTLSLGAAMTQPPPEKTPAKKHVRLQESGGLCLQAGLQCGSDAGRSVPGGRRTHLLCEHTPGGHPTLSAHCWTPPYPLGPSAPATQPQATGRRILEDPFKLCQPRRPGHPWPRLQGPIQDHLAKSPEPCLSRPGTEPGGR

SEQ ID NO: 69254 - protein, 140 aa, Homo sapiens
  Payload ID: 13753
  Gene Symbol: PTPN7
  Gene Name: protein tyrosine phosphatase, non-receptor type 7
  ENSP ID: ENSP00000417350
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGR

SEQ ID NO: 69255 - protein, 102 aa, Homo sapiens
  Payload ID: 13753
  Gene Symbol: PTPN7
  Gene Name: protein tyrosine phosphatase, non-receptor type 7
  ENSP ID: ENSP00000417410
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFL

SEQ ID NO: 69256 - protein, 122 aa, Homo sapiens
  Payload ID: 13753
  Gene Symbol: PTPN7
  Gene Name: protein tyrosine phosphatase, non-receptor type 7
  ENSP ID: ENSP00000418129
MPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCRC

SEQ ID NO: 69257 - protein, 441 aa, Homo sapiens
  Payload ID: 13753
  Gene Symbol: PTPN7
  Gene Name: protein tyrosine phosphatase, non-receptor type 7
  ENSP ID: ENSP00000418416
KRRRAASMNRLGCWPARSLPRSGRGSGQRSLGLGGHPSGPRHPGTPAAKRTWESPGVRARDCPLSTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 69258 - protein, 153 aa, Homo sapiens
  Payload ID: 13753
  Gene Symbol: PTPN7
  Gene Name: protein tyrosine phosphatase, non-receptor type 7
  ENSP ID: ENSP00000418837
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLIPSNFVSPEDLDIPGHASKDRYKTILPNPQSRVCLGRAQSQEDGDYINANY

SEQ ID NO: 69259 - protein, 116 aa, Homo sapiens
  Payload ID: 13753
  Gene Symbol: PTPN7
  Gene Name: protein tyrosine phosphatase, non-receptor type 7
  ENSP ID: ENSP00000419196
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKRKPMDPSRSASRT

SEQ ID NO: 69260 - protein, 140 aa, Homo sapiens
  Payload ID: 13753
  Gene Symbol: PTPN7
  Gene Name: protein tyrosine phosphatase, non-receptor type 7
  ENSP ID: ENSP00000419523
MVQAHGGRSRAQPLTLSLGAAMTQPPPEKTPAKKHVRLQERTHLLCEHTPGGHPTLSAHCWTPPYPLGPSAPATQPQATGRRILEDPFKLCQPRRPGHPWPRLQGPIQDHLAKSPEPCLSRPGTEPGGRRLHQCQLHPRL

SEQ ID NO: 69261 - protein, 76 aa, Homo sapiens
  Payload ID: 13753
  Gene Symbol: PTPN7
  Gene Name: protein tyrosine phosphatase, non-receptor type 7
  ENSP ID: ENSP00000419733
MVQAHGGRSRAQPLTLSLGAAMTQPPPEKTPAKKHVRLQERRSLQTLSAPKTWTSLATPPRTDTRPSCQIPRAVSV

SEQ ID NO: 69262 - protein, 163 aa, Homo sapiens
  Payload ID: 13753
  Gene Symbol: PTPN7
  Gene Name: protein tyrosine phosphatase, non-receptor type 7
  ENSP ID: ENSP00000419993
MTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVW

SEQ ID NO: 69263 - protein, 154 aa, Homo sapiens
  Payload ID: 13753
  Gene Symbol: PTPN7
  Gene Name: protein tyrosine phosphatase, non-receptor type 7
  ENSP ID: ENSP00000420434
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANY

SEQ ID NO: 69264 - protein, 360 aa, Homo sapiens
  Payload ID: 13753
  Gene Symbol: PTPN7
  Gene Name: protein tyrosine phosphatase, non-receptor type 7
  Uniprot ID: P35236
  ENSP ID: ENSP00000420506
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 69265 - protein, 116 aa, Homo sapiens; identical to SEQ ID NO: 69259
  Payload ID: 13753
  Gene Symbol: PTPN7
  Gene Name: protein tyrosine phosphatase, non-receptor type 7
  ENSP ID: ENSP00000485691

SEQ ID NO: 69266 - protein, 583 aa, Homo sapiens
  Payload ID: 13754
  Gene Symbol: PTPN9
  Gene Name: protein tyrosine phosphatase, non-receptor type 9
  ENSP ID: ENSP00000303554
MAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 69267 - protein, 174 aa, Homo sapiens
  Payload ID: 13754
  Gene Symbol: PTPN9
  Gene Name: protein tyrosine phosphatase, non-receptor type 9
  ENSP ID: ENSP00000455934
VKLKPHEEPLRSEILSGKFTILNVRDPTGASIALFTARLHHPHKSVQHVVLQALFYLLDRAVDSFETQRNGLVFIYDMCGSNYANFELDLGKKVLNLLKLPFSSTDLEKPQHSSMENIQHLEQTSPKASSLKCDKLLSSFPSKMQQFISGPKCPRSFYQQIKNHSRKTPVISTK

SEQ ID NO: 69268 - protein, 593 aa, Homo sapiens
  Payload ID: 13754
  Gene Symbol: PTPN9
  Gene Name: protein tyrosine phosphatase, non-receptor type 9
  Uniprot ID: P43378
  ENSP ID: ENSP00000482732
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 69269 - protein, 793 aa, Homo sapiens
  Payload ID: 13755
  Gene Symbol: PTPRA
  Gene Name: protein tyrosine phosphatase, receptor type, A
  Uniprot ID: P18433
  ENSP ID: ENSP00000216877
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 69270 - protein, 793 aa, Homo sapiens; identical to SEQ ID NO: 69269
  Payload ID: 13755
  Gene Symbol: PTPRA
  Gene Name: protein tyrosine phosphatase, receptor type, A
  Uniprot ID: P18433
  ENSP ID: ENSP00000314568

SEQ ID NO: 69271 - protein, 793 aa, Homo sapiens; identical to SEQ ID NO: 69269
  Payload ID: 13755
  Gene Symbol: PTPRA
  Gene Name: protein tyrosine phosphatase, receptor type, A
  Uniprot ID: P18433
  ENSP ID: ENSP00000348468

SEQ ID NO: 69272 - protein, 802 aa, Homo sapiens
  Payload ID: 13755
  Gene Symbol: PTPRA
  Gene Name: protein tyrosine phosphatase, receptor type, A
  Uniprot ID: P18433
  ENSP ID: ENSP00000369756
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 69273 - protein, 802 aa, Homo sapiens; identical to SEQ ID NO: 69272
  Payload ID: 13755
  Gene Symbol: PTPRA
  Gene Name: protein tyrosine phosphatase, receptor type, A
  Uniprot ID: P18433
  ENSP ID: ENSP00000382787

SEQ ID NO: 69274 - protein, 138 aa, Homo sapiens
  Payload ID: 13755
  Gene Symbol: PTPRA
  Gene Name: protein tyrosine phosphatase, receptor type, A
  ENSP ID: ENSP00000390775
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPS

SEQ ID NO: 69275 - protein, 175 aa, Homo sapiens
  Payload ID: 13755
  Gene Symbol: PTPRA
  Gene Name: protein tyrosine phosphatase, receptor type, A
  ENSP ID: ENSP00000394132
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYML

SEQ ID NO: 69276 - protein, 253 aa, Homo sapiens
  Payload ID: 13755
  Gene Symbol: PTPRA
  Gene Name: protein tyrosine phosphatase, receptor type, A
  ENSP ID: ENSP00000414089
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASK

SEQ ID NO: 69277 - protein, 1997 aa, Homo sapiens
  Payload ID: 13756
  Gene Symbol: PTPRB
  Gene Name: protein tyrosine phosphatase, receptor type, B
  Uniprot ID: P23467
  ENSP ID: ENSP00000261266
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 69278 - protein, 2215 aa, Homo sapiens
  Payload ID: 13756
  Gene Symbol: PTPRB
  Gene Name: protein tyrosine phosphatase, receptor type, B
  Uniprot ID: P23467
  ENSP ID: ENSP00000334928
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 69279 - protein, 919 aa, Homo sapiens
  Payload ID: 13756
  Gene Symbol: PTPRB
  Gene Name: protein tyrosine phosphatase, receptor type, B
  ENSP ID: ENSP00000393028
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPDKVQGVSVSNSARSDYLRVSWVHATGDFDHYEVTIKNKNNFIQTKAFPSQKTNVYLFS

SEQ ID NO: 69280 - protein, 1907 aa, Homo sapiens
  Payload ID: 13756
  Gene Symbol: PTPRB
  Gene Name: protein tyrosine phosphatase, receptor type, B
  Uniprot ID: P23467
  ENSP ID: ENSP00000438927
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 69281 - protein, 103 aa, Homo sapiens
  Payload ID: 13756
  Gene Symbol: PTPRB
  Gene Name: protein tyrosine phosphatase, receptor type, B
  ENSP ID: ENSP00000446934
  MOD_RES (1)..(1): Any amino acid
XLWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTGKG

SEQ ID NO: 69282 - protein, 1407 aa, Homo sapiens
  Payload ID: 13756
  Gene Symbol: PTPRB
  Gene Name: protein tyrosine phosphatase, receptor type, B
  ENSP ID: ENSP00000446982
MEAEFYMVILTCLIFRNSEGFQIVHVQKQQCLFKNEKVVVGSCNRTIQNQQWMWTEDEKLLHVKSALCLAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYN

SEQ ID NO: 69283 - protein, 1907 aa, Homo sapiens
  Payload ID: 13756
  Gene Symbol: PTPRB
  Gene Name: protein tyrosine phosphatase, receptor type, B
  Uniprot ID: P23467
  ENSP ID: ENSP00000447302
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 69284 - protein, 2127 aa, Homo sapiens
  Payload ID: 13756
  Gene Symbol: PTPRB
  Gene Name: protein tyrosine phosphatase, receptor type, B
  ENSP ID: ENSP00000448058
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 69285 - protein, 1583 aa, Homo sapiens
  Payload ID: 13756
  Gene Symbol: PTPRB
  Gene Name: protein tyrosine phosphatase, receptor type, B
  ENSP ID: ENSP00000448349
MEAEFYMVILTCLIFRNSGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTSMTCFATLISQME

SEQ ID NO: 69286 - protein, 1145 aa, Homo sapiens
  Payload ID: 13757
  Gene Symbol: PTPRC
  Gene Name: protein tyrosine phosphatase, receptor type, C
  ENSP ID: ENSP00000306782
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 69287 - protein, 36 aa, Homo sapiens
  Payload ID: 13757
  Gene Symbol: PTPRC
  Gene Name: protein tyrosine phosphatase, receptor type, C
  ENSP ID: ENSP00000356334
MTMYLWLKLLAFGFAFLDTEVFVTGQSPTPSPTGKN

SEQ ID NO: 69288 - protein, 735 aa, Homo sapiens
  Payload ID: 13757
  Gene Symbol: PTPRC
  Gene Name: protein tyrosine phosphatase, receptor type, C
  ENSP ID: ENSP00000356337
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 69289 - protein, 148 aa, Homo sapiens
  Payload ID: 13757
  Gene Symbol: PTPRC
  Gene Name: protein tyrosine phosphatase, receptor type, C
  ENSP ID: ENSP00000356349
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLH

SEQ ID NO: 69290 - protein, 118 aa, Homo sapiens
  Payload ID: 13757
  Gene Symbol: PTPRC
  Gene Name: protein tyrosine phosphatase, receptor type, C
  ENSP ID: ENSP00000393360
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTP

SEQ ID NO: 69291 - protein, 87 aa, Homo sapiens
  Payload ID: 13757
  Gene Symbol: PTPRC
  Gene Name: protein tyrosine phosphatase, receptor type, C
  ENSP ID: ENSP00000405494
MTMYLWLKLLAFGFAFLDTEVFVTGQSPTPSPTGHLQAEEQGSQSKSPNLKSREADSSAFSWWPKAREPLTNHWSKSKSPKAEELGV

SEQ ID NO: 69292 - protein, 1306 aa, Homo sapiens
  Payload ID: 13757
  Gene Symbol: PTPRC
  Gene Name: protein tyrosine phosphatase, receptor type, C
  ENSP ID: ENSP00000411355
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 69293 - protein, 600 aa, Homo sapiens
  Payload ID: 13757
  Gene Symbol: PTPRC
  Gene Name: protein tyrosine phosphatase, receptor type, C
  ENSP ID: ENSP00000433536
MTMYLWLKLLAFGFAFLDTEVFVTGQSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYID

SEQ ID NO: 69294 - protein, 34 aa, Homo sapiens
  Payload ID: 13757
  Gene Symbol: PTPRC
  Gene Name: protein tyrosine phosphatase, receptor type, C
  ENSP ID: ENSP00000458191
MYLWLKLLAFGFAFLDTEVFVTGQSPTPSPTGKN

SEQ ID NO: 69295 - protein, 571 aa, Homo sapiens
  Payload ID: 13757
  Gene Symbol: PTPRC
  Gene Name: protein tyrosine phosphatase, receptor type, C
  Uniprot ID: P08575
  ENSP ID: ENSP00000458322
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTS

SEQ ID NO: 69296 - protein, 85 aa, Homo sapiens
  Payload ID: 13757
  Gene Symbol: PTPRC
  Gene Name: protein tyrosine phosphatase, receptor type, C
  ENSP ID: ENSP00000458418
MYLWLKLLAFGFAFLDTEVFVTGQSPTPSPTGHLQAEEQGSQSKSPNLKSREADSSAFSWWPKAREPLTNHWSKSKSPKAEELGV

SEQ ID NO: 69297 - protein, 505 aa, Homo sapiens
  Payload ID: 13757
  Gene Symbol: PTPRC
  Gene Name: protein tyrosine phosphatase, receptor type, C
  ENSP ID: ENSP00000458662
MYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTS

SEQ ID NO: 69298 - protein, 146 aa, Homo sapiens
  Payload ID: 13757
  Gene Symbol: PTPRC
  Gene Name: protein tyrosine phosphatase, receptor type, C
  ENSP ID: ENSP00000458846
MYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLH

SEQ ID NO: 69299 - protein, 410 aa, Homo sapiens
  Payload ID: 13757
  Gene Symbol: PTPRC
  Gene Name: protein tyrosine phosphatase, receptor type, C
  Uniprot ID: P08575
  ENSP ID: ENSP00000461074
MYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTS

SEQ ID NO: 69300 - protein, 457 aa, Homo sapiens
  Payload ID: 13757
  Gene Symbol: PTPRC
  Gene Name: protein tyrosine phosphatase, receptor type, C
  ENSP ID: ENSP00000461347
MYLWLKLLAFGFAFLDTEVFVTGQSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTS

SEQ ID NO: 69301 - protein, 116 aa, Homo sapiens
  Payload ID: 13757
  Gene Symbol: PTPRC
  Gene Name: protein tyrosine phosphatase, receptor type, C
  ENSP ID: ENSP00000461712
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTP

SEQ ID NO: 69302 - protein, 753 aa, Homo sapiens
  Payload ID: 13757
  Gene Symbol: PTPRC
  Gene Name: protein tyrosine phosphatase, receptor type, C
  ENSP ID: ENSP00000469141
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 69303 - protein, 523 aa, Homo sapiens
  Payload ID: 13757
  Gene Symbol: PTPRC
  Gene Name: protein tyrosine phosphatase, receptor type, C
  ENSP ID: ENSP00000482203
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTS

SEQ ID NO: 69304 - protein, 91 aa, Homo sapiens
  Payload ID: 13757
  Gene Symbol: PTPRC
  Gene Name: protein tyrosine phosphatase, receptor type, C
  ENSP ID: ENSP00000483380
  MOD_RES (1)..(1): Any amino acid
XKLLAFGFAFLDTEVFGKAQHLPPLVFHQYRRLTFPRTQTRRRPLLELTRRHSAAPPPMQNSTLPQAAMLSQMSQERGVQPAPFLQTQFPH

SEQ ID NO: 69305 - protein, 206 aa, Homo sapiens
  Payload ID: 13758
  Gene Symbol: PTPRCAP
  Gene Name: protein tyrosine phosphatase, receptor type, C-associated protein
  Uniprot ID: Q14761
  ENSP ID: ENSP00000325589
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 69306 - protein, 1506 aa, Homo sapiens
  Payload ID: 13759
  Gene Symbol: PTPRD
  Gene Name: protein tyrosine phosphatase, receptor type, D
  Uniprot ID: P23468
  ENSP ID: ENSP00000347373
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69307 - protein, 1912 aa, Homo sapiens
  Payload ID: 13759
  Gene Symbol: PTPRD
  Gene Name: protein tyrosine phosphatase, receptor type, D
  Uniprot ID: P23468
  ENSP ID: ENSP00000348812
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69308 - protein, 1912 aa, Homo sapiens; identical to SEQ ID NO: 69307
  Payload ID: 13759
  Gene Symbol: PTPRD
  Gene Name: protein tyrosine phosphatase, receptor type, D
  Uniprot ID: P23468
  ENSP ID: ENSP00000370593

SEQ ID NO: 69309 - protein, 1505 aa, Homo sapiens
  Payload ID: 13759
  Gene Symbol: PTPRD
  Gene Name: protein tyrosine phosphatase, receptor type, D
  Uniprot ID: P23468
  ENSP ID: ENSP00000380731
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGSDDSGYPGNLHSSSMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69310 - protein, 1502 aa, Homo sapiens
  Payload ID: 13759
  Gene Symbol: PTPRD
  Gene Name: protein tyrosine phosphatase, receptor type, D
  Uniprot ID: P23468
  ENSP ID: ENSP00000380735
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69311 - protein, 1505 aa, Homo sapiens [sequence omitted]

SEQ ID NO: 69312 - protein, 1505 aa, Homo sapiens
  Payload ID: 13759
  Gene Symbol: PTPRD
  Gene Name: protein tyrosine phosphatase, receptor type, D
  Uniprot ID: P23468
  ENSP ID: ENSP00000417093
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69313 - protein, 202 aa, Homo sapiens
  Payload ID: 13759
  Gene Symbol: PTPRD
  Gene Name: protein tyrosine phosphatase, receptor type, D
  ENSP ID: ENSP00000417661
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGTDFSPSSLSLLLNGWSMFVMS

SEQ ID NO: 69314 - protein, 93 aa, Homo sapiens
  Payload ID: 13759
  Gene Symbol: PTPRD
  Gene Name: protein tyrosine phosphatase, receptor type, D
  ENSP ID: ENSP00000417890
MVHVARLLLLLLTFFLRTDAETPPRFTRTPVDQTGVSGGVASFICQATGDPRPKIVWNKKGKKVSNQRFEVIEFDDGSGSVLRIQPLRTPRDE

SEQ ID NO: 69315 - protein, 1912 aa, Homo sapiens; identical to SEQ ID NO: 69307
  Payload ID: 13759
  Gene Symbol: PTPRD
  Gene Name: protein tyrosine phosphatase, receptor type, D
  Uniprot ID: P23468
  ENSP ID: ENSP00000438164

SEQ ID NO: 69316 - protein, 1496 aa, Homo sapiens
  Payload ID: 13759
  Gene Symbol: PTPRD
  Gene Name: protein tyrosine phosphatase, receptor type, D
  ENSP ID: ENSP00000440515
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSTVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 69317 - protein, 700 aa, Homo sapiens
  Payload ID: 13760
  Gene Symbol: PTPRE
  Gene Name: protein tyrosine phosphatase, receptor type, E
  Uniprot ID: P23469
  ENSP ID: ENSP00000254667
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 69318 - protein, 642 aa, Homo sapiens
  Payload ID: 13760
  Gene Symbol: PTPRE
  Gene Name: protein tyrosine phosphatase, receptor type, E
  Uniprot ID: P23469
  ENSP ID: ENSP00000303350
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 69319 - protein, 140 aa, Homo sapiens
  Payload ID: 13760
  Gene Symbol: PTPRE
  Gene Name: protein tyrosine phosphatase, receptor type, E
  ENSP ID: ENSP00000410540
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFN

SEQ ID NO: 69320 - protein, 153 aa, Homo sapiens
  Payload ID: 13760
  Gene Symbol: PTPRE
  Gene Name: protein tyrosine phosphatase, receptor type, E
  ENSP ID: ENSP00000416939
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFEL

SEQ ID NO: 69321 - protein, 536 aa, Homo sapiens
  Payload ID: 13760
  Gene Symbol: PTPRE
  Gene Name: protein tyrosine phosphatase, receptor type, E
  ENSP ID: ENSP00000473761
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPCKAPVAWLGQGWGGAGAGGFHPGEAIDRLPLCTRVKSRVSSGLRLRAPVCCTKCQVEKTPVKHQLTQTVLHGSQASCFGYELADAGGQPRLISGEGFTEAGDLRQARLGIPCLIPCLPKPGQRPASPLHRGA

SEQ ID NO: 69322 - protein, 149 aa, Homo sapiens
  Payload ID: 13760
  Gene Symbol: PTPRE
  Gene Name: protein tyrosine phosphatase, receptor type, E
  ENSP ID: ENSP00000474102
MEPLCPLLLVGFSLPLARALRGNETTADSNETTTTSGPPDPGASQPLLAWLLLPLLLLLLVLLLAAYFFRFRKQRKAVVSTSDKKMPNGILEEQAKGDAAQQVTLRAQEVFSHPRGAPGGGDPYQIRRRLQAVSGGVQLIAIWTHTRNF

SEQ ID NO: 69323 - protein, 107 aa, Homo sapiens
  Payload ID: 13760
  Gene Symbol: PTPRE
  Gene Name: protein tyrosine phosphatase, receptor type, E
  ENSP ID: ENSP00000474830
RLPAAAGLAATAAAAPPPRAPSRRLLLQEAEESCGQHQRQEDAQRNLGGARAAKGDAAQQVTLRAQEVFSHPRGAPGGGDPYQIRRRLQAVSGGVQLIAIWTHTRNF

SEQ ID NO: 69324 - protein, 118 aa, Homo sapiens
  Payload ID: 13760
  Gene Symbol: PTPRE
  Gene Name: protein tyrosine phosphatase, receptor type, E
  ENSP ID: ENSP00000475063
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPRLQREE

SEQ ID NO: 69325 - protein, 1907 aa, Homo sapiens
  Payload ID: 13761
  Gene Symbol: PTPRF
  Gene Name: protein tyrosine phosphatase, receptor type, F
  Uniprot ID: P10586
  ENSP ID: ENSP00000353030
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69326 - protein, 979 aa, Homo sapiens
  Payload ID: 13761
  Gene Symbol: PTPRF
  Gene Name: protein tyrosine phosphatase, receptor type, F
  ENSP ID: ENSP00000361484
TYVRLENGEPRGLPIIQDVMLAEAQWRPEESEDYETTISGLTPETTYSVTVAAYTTKGDGARSKPKIVTTTGAVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69327 - protein, 1291 aa, Homo sapiens
  Payload ID: 13761
  Gene Symbol: PTPRF
  Gene Name: protein tyrosine phosphatase, receptor type, F
  ENSP ID: ENSP00000391764
  MOD_RES (1)..(1): Any amino acid
XSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSMPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69328 - protein, 1898 aa, Homo sapiens
  Payload ID: 13761
  Gene Symbol: PTPRF
  Gene Name: protein tyrosine phosphatase, receptor type, F
  Uniprot ID: P10586
  ENSP ID: ENSP00000398822
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69329 - protein, 1553 aa, Homo sapiens
  Payload ID: 13761
  Gene Symbol: PTPRF
  Gene Name: protein tyrosine phosphatase, receptor type, F
  ENSP ID: ENSP00000408952
  MOD_RES (1)..(1): Any amino acid
XEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69330 - protein, 262 aa, Homo sapiens
  Payload ID: 13761
  Gene Symbol: PTPRF
  Gene Name: protein tyrosine phosphatase, receptor type, F
  ENSP ID: ENSP00000413306
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRGLAAWARSPMGIWSHPIRLLGVCACVCAHTGTLICV

SEQ ID NO: 69331 - protein, 1332 aa, Homo sapiens
  Payload ID: 13761
  Gene Symbol: PTPRF
  Gene Name: protein tyrosine phosphatase, receptor type, F
  ENSP ID: ENSP00000416343
  MOD_RES (1)..(1): Any amino acid
XSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSMPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 69332 - protein, 262 aa, Homo sapiens; identical to SEQ ID NO: 69330
  Payload ID: 13761
  Gene Symbol: PTPRF
  Gene Name: protein tyrosine phosphatase, receptor type, F
  ENSP ID: ENSP00000483557

SEQ ID NO: 69333 - protein, 1202 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  Uniprot ID: Q13136
  ENSP ID: ENSP00000253925
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 69334 - protein, 1185 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  Uniprot ID: Q13136
  ENSP ID: ENSP00000374198
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGM

SEQ ID NO: 69335 - protein, 99 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000432065
MMCEVMPTISEAEGPPGGGGGHGSGSPSQPDADSHFEQLMVSMLEERDRLLDTLRETQETLALTQGKLHEVGHERDSLQRQLNTALPQEFAALTKELNV

SEQ ID NO: 69336 - protein, 158 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000432722
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEV

SEQ ID NO: 69337 - protein, 33 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000432913
  MOD_RES (1)..(1): Any amino acid
XQNTGALQECTAPLQCSFPCVKLTWTVSAQIAG

SEQ ID NO: 69338 - protein, 237 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000433114
  MOD_RES (1)..(1): Any amino acid
XTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALG

SEQ ID NO: 69339 - protein, 583 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000433619
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRADPTWAVSQISGSPWQTATQTPTAPVQCCGAHRKAGWQPCEMSLPRYKLLMSRIGNVPSKLVSWQM

SEQ ID NO: 69340 - protein, 389 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000434445
  MOD_RES (1)..(1): Any amino acid
XADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLPSPDSFLIQTSGPHQSVVYSSTSPPSSTPCYSDSSQHAQLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTS

SEQ ID NO: 69341 - protein, 98 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000434692
  MOD_RES (1)..(1): Any amino acid
XTKGHSWLSCWVSRDSPCKLPGDFFYVFPLYAAKEDADGRLPTLLLQMIMQHLNPTKTTFWNPVESLILLILVIWTLRYFITEFLISEKFMNTIEKIF

SEQ ID NO: 69342 - protein, 387 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000435752
  MOD_RES (1)..(1): Any amino acid
XPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKSDLLSSGSSAAKEAKLLELTSKLRKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKARYKLLMSRIGNVPSKLVSWQM

SEQ ID NO: 69343 - protein, 46 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000435978
SQPSSGSGQTGRHDPSISRFIFNPDLRSPSVSSLLIHLPSQFHPML

SEQ ID NO: 69344 - protein, 97 aa, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENSP ID: ENSP00000437024
  MOD_RES (1)..(1): Any amino acid
XKQLEETQHDKDQLVLNIEALRAELDHMRLRADPTWAVSQISGSPWQTATQTPTAPVQCCGAHRKAGWQPCEMSLPRYKLLMSRIGNVPSKLVSWQM

SEQ ID NO: 69345 - protein, 1152 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000327416
MIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69346 - protein, 1156 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000385093
MIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69347 - protein, 1152 aa, Homo sapiens; identical to SEQ ID NO: 69345
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000388373

SEQ ID NO: 69348 - protein, 783 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000438337
MRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 69349 - protein, 443 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000445532
MTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69350 - protein, 284 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000446555
  MOD_RES (1)..(1): Any amino acid
XHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQVQYLCLGFLLVCAFSSFSQNGMEEKNRQLQERLELAEQKLQQTMRKAETLPEVEAELAQRIAALTKAEERHGNIEERMRHLEGQLEEKN

SEQ ID NO: 69351 - protein, 188 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000447189
  MOD_RES (1)..(1): Any amino acid
XQAEKDRRLKKNTSGHELLEEARRKGLPFAQWDGPTVVAWLELWLGMPAWYVAACRANVKSGAIMSALSDTEIQREIGISNPLHRLKLRLAIQEMVSLTSPSAPPTSRTCPVFLQTLAYGDMNHEWIGNEWLPSLGLPQYRSYFMECLVDARMLDHLTKKDLRVHLKMVDSFHRTSLQYGIMCLKRLN

SEQ ID NO: 69352 - protein, 1104 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000447273
MTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69353 - protein, 124 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000447792
MRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRY

SEQ ID NO: 69354 - protein, 1236 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000447868
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69355 - protein, 121 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000447918
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKE

SEQ ID NO: 69356 - protein, 265 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000448941
MFAAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENR

SEQ ID NO: 69357 - protein, 1251 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000449338
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69358 - protein, 147 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000449469
MMCEVMPTINEDTPMSQRGSQSSGSDSDSHFEQLMVNMLDERDRLLDTLRETQESLSLAQQRLQDVIYDRDSLQRQLNSALPQEFAALTKELNACREQLLEKEEEISELKAERNNTRLLLEHLECLVSRHERSLRMTVVKRQAQSPS

SEQ ID NO: 69359 - protein, 188 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000449524
  MOD_RES (1)..(1): Any amino acid
XGKKEKARLGQLRGFMETEAAAQESLGLGKLGTQAEKDRRLKKNTSGHELLEEARRKGLPFAQWDGPTVVAWLELWLGMPAWYVAACRANVKSGAIMSALSDTEIQREIGISNPLHRLKLRLAIQEMVSLTSPSAPPTSRTKESEEGSWAQCPVFLQTLAYGDMNHEWIGNEWLPSLGLPQYRSYFME

SEQ ID NO: 69360 - protein, 1247 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000449558
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 69361 - protein, 81 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENSP ID: ENSP00000449821
MRHLEGQLEEKNQELQRARQREKMNEEHNKRLSDTVDRLLTESNERLQLHLKERMAALEEKLAATRPARVMRAGYQFQSIN

SEQ ID NO: 69362 - protein, 1232 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000450298
MMCEVMPTINEDTPMSQRGSQSSGSDSDSHFEQLMVNMLDERDRLLDTLRETQESLSLAQQRLQDVIYDRDSLQRQLNSALPQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKNTSGHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 69363 - protein, 1257 aa, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENSP ID: ENSP00000450337
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 69364 - protein, 1194 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  Uniprot ID: O75145
  ENSP ID: ENSP00000335614
MMCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKETTEQRAEELESRVSSSGLDSLGRYRSSCSLPPSLTTSTLASPSPPSSGHSTPRLAPPSPAREGTDKANHVPKEEAGAPRGEGPAIPGDTPPPTPRSARLERMTQALALQAGSLEDGGPPRGSEGTPDSLHKAPKKKSIKSSIGRLFGKKEKGRMGPPGRDSSSLAGTPSDETLATDPLGLAKLTGPGDKDRRNKRKHELLEEACRQGLPFAAWDGPTVVSWLELWVGMPAWYVAACRANVKSGAIMANLSDTEIQREIGISNPLHRLKLRLAIQEMVSLTSPSAPASSRTSTGNVWMTHEEMESLTATTKPETKEISWEQILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 69365 - protein, 277 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENSP ID: ENSP00000473418
APASSRTSTGNVWMTHEEMESLTATTKPILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 69366 - protein, 243 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENSP ID: ENSP00000473423
MNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 69367 - protein, 652 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENSP ID: ENSP00000473470
MMCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKIMSLRRKLELHEGRGRPSQETPHHPLPALPVLRE

SEQ ID NO: 69368 - protein, 146 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENSP ID: ENSP00000473621
MMCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGV

SEQ ID NO: 69369 - protein, 1185 aa, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  Uniprot ID: O75145
  ENSP ID: ENSP00000473622
MMCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKETTEQRAEELESRVSSSGLDSLGRYRSSCSLPPSLTTSTLASPSPPSSGHSTPRLAPPSPAREGTDKANHVPKEEAGAPRGEGPAIPGDTPPPTPRSARLERMTQALALQAGSLEDGGPPRGSEGTPDSLHKAPKKKSIKSSIGRLFGKKEKGRMGPPGRDSSSLAGTPSDETLATDPLGLAKLTGPGDKDRRNKRKHELLEEACRQGLPFAAWDGPTVVSWLELWVGMPAWYVAACRANVKSGAIMANLSDTEIQREIGISNPLHRLKLRLAIQEMVSLTSPSAPASSRTSTGNVWMTHEEMESLTATTKPILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 69370 - protein, 701 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENSP ID: ENSP00000272198
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 69371 - protein, 692 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENSP ID: ENSP00000295706
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 69372 - protein, 1186 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENSP ID: ENSP00000356209
MCEVMPTINEGDRLGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 69373 - protein, 1185 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENSP ID: ENSP00000402576
MCEVMPTINEGDRLGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARTAVQVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKLALPLTVTLRSPTWMRMSQGVCCNLEYHSSGTLCGSSGPLPVPEMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 69374 - protein, 953 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENSP ID: ENSP00000470427
  MOD_RES (1)..(1): Any amino acid
XVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 69375 - protein, 692 aa, Homo sapiens; identical to SEQ ID NO: 69371
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENSP ID: ENSP00000471264

SEQ ID NO: 69376 - protein, 191 aa, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENSP ID: ENSP00000472251
  MOD_RES (1)..(1): Any amino acid
XAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLDAAAREAWPPSPEPGRRQECLGGSGQ

SEQ ID NO: 69377 - protein, 1416 aa, Homo sapiens
  Payload ID: 13766
  Gene Symbol: PTPRG
  Gene Name: protein tyrosine phosphatase, receptor type, G
  Uniprot ID: P23470
  ENSP ID: ENSP00000295874
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 69378 - protein, 1445 aa, Homo sapiens
  Payload ID: 13766
  Gene Symbol: PTPRG
  Gene Name: protein tyrosine phosphatase, receptor type, G
  Uniprot ID: P23470
  ENSP ID: ENSP00000418112
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 69379 - protein, 1354 aa, Homo sapiens
  Payload ID: 13766
  Gene Symbol: PTPRG
  Gene Name: protein tyrosine phosphatase, receptor type, G
  ENSP ID: ENSP00000480407
TGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 69380 - protein, 1383 aa, Homo sapiens
  Payload ID: 13766
  Gene Symbol: PTPRG
  Gene Name: protein tyrosine phosphatase, receptor type, G
  ENSP ID: ENSP00000484346
TGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 69381 - protein, 937 aa, Homo sapiens
  Payload ID: 13767
  Gene Symbol: PTPRH
  Gene Name: protein tyrosine phosphatase, receptor type, H
  Uniprot ID: Q9HD43
  ENSP ID: ENSP00000263434
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 69382 - protein, 1115 aa, Homo sapiens
  Payload ID: 13767
  Gene Symbol: PTPRH
  Gene Name: protein tyrosine phosphatase, receptor type, H
  Uniprot ID: Q9HD43
  ENSP ID: ENSP00000365528
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRNLRVEAQTTSSISLSWEVPDGTDPQNSTYCVQCTGDGGRTETRNTTDTRVTVDGLGPGSLYTCSVWVEKDGVNSSVEIVTSATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 69383 - protein, 1337 aa, Homo sapiens
  Payload ID: 13768
  Gene Symbol: PTPRJ
  Gene Name: protein tyrosine phosphatase, receptor type, J
  Uniprot ID: Q12913
  ENSP ID: ENSP00000400010
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 69384 - protein, 539 aa, Homo sapiens
  Payload ID: 13768
  Gene Symbol: PTPRJ
  Gene Name: protein tyrosine phosphatase, receptor type, J
  Uniprot ID: Q12913
  ENSP ID: ENSP00000409733
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 69385 - protein, 120 aa, Homo sapiens
  Payload ID: 13768
  Gene Symbol: PTPRJ
  Gene Name: protein tyrosine phosphatase, receptor type, J
  ENSP ID: ENSP00000432686
MKPAAREARLPPRSPGLRWALPLLLLLLRLGQILCAGGRPSPVFDIKAVSISPTNVILTWKSNDTAASEYKYVVKHKMENEKTITVVHQPWCNITGLRPATSYVFSITPGIGNETWGDPR

SEQ ID NO: 69386 - protein, 146 aa, Homo sapiens
  Payload ID: 13768
  Gene Symbol: PTPRJ
  Gene Name: protein tyrosine phosphatase, receptor type, J
  ENSP ID: ENSP00000435618
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTEPIPVSDLRVALTGVRKAALSWSNGNGTA

SEQ ID NO: 69387 - protein, 1338 aa, Homo sapiens [sequence omitted]

SEQ ID NO: 69388 - protein, 1342 aa, Homo sapiens
  Payload ID: 13768
  Gene Symbol: PTPRJ
  Gene Name: protein tyrosine phosphatase, receptor type, J
  ENSP ID: ENSP00000479342
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRCLLRACVAGFTNITFHPQNKGLIDGAESYVSFSRYSDAVSLPQDPGVICGAVFGCIFGALVIVTVGGFIFWRKKRKDAKNNEVSFSQIKSLKRSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 69389 - protein, 1472 aa, Homo sapiens
  Payload ID: 13769
  Gene Symbol: PTPRK
  Gene Name: protein tyrosine phosphatase, receptor type, K
  ENSP ID: ENSP00000357190
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69390 - protein, 1458 aa, Homo sapiens
  Payload ID: 13769
  Gene Symbol: PTPRK
  Gene Name: protein tyrosine phosphatase, receptor type, K
  ENSP ID: ENSP00000357193
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69391 - protein, 1446 aa, Homo sapiens
  Payload ID: 13769
  Gene Symbol: PTPRK
  Gene Name: protein tyrosine phosphatase, receptor type, K
  Uniprot ID: Q15262
  ENSP ID: ENSP00000357196
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69392 - protein, 1439 aa, Homo sapiens
  Payload ID: 13769
  Gene Symbol: PTPRK
  Gene Name: protein tyrosine phosphatase, receptor type, K
  Uniprot ID: Q15262
  ENSP ID: ENSP00000357198
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69393 - protein, 1440 aa, Homo sapiens
  Payload ID: 13769
  Gene Symbol: PTPRK
  Gene Name: protein tyrosine phosphatase, receptor type, K
  Uniprot ID: Q15262
  ENSP ID: ENSP00000357209
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69394 - protein, 77 aa, Homo sapiens
  Payload ID: 13769
  Gene Symbol: PTPRK
  Gene Name: protein tyrosine phosphatase, receptor type, K
  ENSP ID: ENSP00000376243
MDTTAAAALPAFVALLLLSPWPLLGSAQGQFSAVSVLVVGNFCCCCSAAVCHSIRHLSRTQNPGQDHEGRLKRWLYF

SEQ ID NO: 69395 - protein, 343 aa, Homo sapiens
  Payload ID: 13769
  Gene Symbol: PTPRK
  Gene Name: protein tyrosine phosphatase, receptor type, K
  ENSP ID: ENSP00000406825
  MOD_RES (1)..(1): Any amino acid
XKAAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWP

SEQ ID NO: 69396 - protein, 260 aa, Homo sapiens
  Payload ID: 13769
  Gene Symbol: PTPRK
  Gene Name: protein tyrosine phosphatase, receptor type, K
  ENSP ID: ENSP00000408180
WRRHICIRNIRRSYYSYSYYLKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWP

SEQ ID NO: 69397 - protein, 20 aa, Homo sapiens
  Payload ID: 13769
  Gene Symbol: PTPRK
  Gene Name: protein tyrosine phosphatase, receptor type, K
  ENSP ID: ENSP00000432960
VHVSAQEPHYLPPEMPQGNI

SEQ ID NO: 69398 - protein, 1462 aa, Homo sapiens
  Payload ID: 13769
  Gene Symbol: PTPRK
  Gene Name: protein tyrosine phosphatase, receptor type, K
  Uniprot ID: Q15262
  ENSP ID: ENSP00000432973
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 69399 - protein, 204 aa, Homo sapiens
  Payload ID: 13769
  Gene Symbol: PTPRK
  Gene Name: protein tyrosine phosphatase, receptor type, K
  ENSP ID: ENSP00000434058
  MOD_RES (1)..(1): Any amino acid
XNPGTLNILVRVNKGPLANPIWNVTGFTGRDWLRAELAVSTFWPNEYQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCA

SEQ ID NO: 69400 - protein, 248 aa, Homo sapiens
  Payload ID: 13769
  Gene Symbol: PTPRK
  Gene Name: protein tyrosine phosphatase, receptor type, K
  ENSP ID: ENSP00000434116
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIICTFLVYVLMSSVLTICVIHRCKYASHGNERLPSCLPHPHYWGSVIHRYTYASHGNERLPLFLPHPVDEEVFGDIGTKPSN

SEQ ID NO: 69401 - protein, 39 aa, Homo sapiens
  Payload ID: 13769
  Gene Symbol: PTPRK
  Gene Name: protein tyrosine phosphatase, receptor type, K
  ENSP ID: ENSP00000437299
MDTTAAAALPAFVALLLLSPWPLLGSAQGQFSAEKACSY

SEQ ID NO: 69402 - protein, 1462 aa, Homo sapiens; identical to SEQ ID NO: 69398
  Payload ID: 13769
  Gene Symbol: PTPRK
  Gene Name: protein tyrosine phosphatase, receptor type, K
  Uniprot ID: Q15262
  ENSP ID: ENSP00000477791

SEQ ID NO: 69403 - protein, 77 aa, Homo sapiens; identical to SEQ ID NO: 69394
  Payload ID: 13769
  Gene Symbol: PTPRK
  Gene Name: protein tyrosine phosphatase, receptor type, K
  ENSP ID: ENSP00000482183

SEQ ID NO: 69404 - protein, 1440 aa, Homo sapiens; identical to SEQ ID NO: 69393
  Payload ID: 13769
  Gene Symbol: PTPRK
  Gene Name: protein tyrosine phosphatase, receptor type, K
  Uniprot ID: Q15262
  ENSP ID: ENSP00000483766

SEQ ID NO: 69405 - protein, 1446 aa, Homo sapiens; identical to SEQ ID NO: 69391
  Payload ID: 13769
  Gene Symbol: PTPRK
  Gene Name: protein tyrosine phosphatase, receptor type, K
  Uniprot ID: Q15262
  ENSP ID: ENSP00000484742

SEQ ID NO: 69406 - protein, 314 aa, Homo sapiens
  Payload ID: 13769
  Gene Symbol: PTPRK
  Gene Name: protein tyrosine phosphatase, receptor type, K
  ENSP ID: ENSP00000485812
  MOD_RES (1)..(1): Any amino acid
XAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEY

SEQ ID NO: 69407 - protein, 39 aa, Homo sapiens; identical to SEQ ID NO: 69401
  Payload ID: 13769
  Gene Symbol: PTPRK
  Gene Name: protein tyrosine phosphatase, receptor type, K
  ENSP ID: ENSP00000485893

SEQ ID NO: 69408 - protein, 20 aa, Homo sapiens
  Payload ID: 13769
  Gene Symbol: PTPRK
  Gene Name: protein tyrosine phosphatase, receptor type, K
  ENSP ID: ENSP00000486036
VHVSAQEPHYLPPEMPQGNI

SEQ ID NO: 69409 - protein, 1439 aa, Homo sapiens; identical to SEQ ID NO: 69392
  Payload ID: 13769
  Gene Symbol: PTPRK
  Gene Name: protein tyrosine phosphatase, receptor type, K
  Uniprot ID: Q15262
  ENSP ID: ENSP00000486442

SEQ ID NO: 69410 - protein, 248 aa, Homo sapiens; identical to SEQ ID NO: 69400
  Payload ID: 13769
  Gene Symbol: PTPRK
  Gene Name: protein tyrosine phosphatase, receptor type, K
  ENSP ID: ENSP00000486448

SEQ ID NO: 69411 - protein, 1472 aa, Homo sapiens; identical to SEQ ID NO: 69389
  Payload ID: 13769
  Gene Symbol: PTPRK
  Gene Name: protein tyrosine phosphatase, receptor type, K
  ENSP ID: ENSP00000487005

SEQ ID NO: 69412 - protein, 1458 aa, Homo sapiens; identical to SEQ ID NO: 69390
  Payload ID: 13769
  Gene Symbol: PTPRK
  Gene Name: protein tyrosine phosphatase, receptor type, K
  ENSP ID: ENSP00000487066

SEQ ID NO: 69413 - protein, 204 aa, Homo sapiens; identical to SEQ ID NO: 69399
  Payload ID: 13769
  Gene Symbol: PTPRK
  Gene Name: protein tyrosine phosphatase, receptor type, K
  ENSP ID: ENSP00000487445
  MOD_RES (1)..(1): Any amino acid

SEQ ID NO: 69414 - protein, 260 aa, Homo sapiens; identical to SEQ ID NO: 69396
  Payload ID: 13769
  Gene Symbol: PTPRK
  Gene Name: protein tyrosine phosphatase, receptor type, K
  ENSP ID: ENSP00000487578

SEQ ID NO: 69415 - protein, 1452 aa, Homo sapiens
  Payload ID: 13770
  Gene Symbol: PTPRM
  Gene Name: protein tyrosine phosphatase, receptor type, M
  Uniprot ID: P28827
  ENSP ID: ENSP00000331418
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 69416 - protein, 1390 aa, Homo sapiens
  Payload ID: 13770
  Gene Symbol: PTPRM
  Gene Name: protein tyrosine phosphatase, receptor type, M
  ENSP ID: ENSP00000382927
MPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 69417 - protein, 279 aa, Homo sapiens
  Payload ID: 13770
  Gene Symbol: PTPRM
  Gene Name: protein tyrosine phosphatase, receptor type, M
  ENSP ID: ENSP00000382933
MNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 69418 - protein, 264 aa, Homo sapiens
  Payload ID: 13770
  Gene Symbol: PTPRM
  Gene Name: protein tyrosine phosphatase, receptor type, M
  ENSP ID: ENSP00000462176
  MOD_RES (1)..(1): Any amino acid
XEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKAAIIVTQLTTPYIRIAPAAGDGQLTGAATPKPVPEPEKQTDHTVKIAGVIAGILLFVIIFLGVVLVMKK

SEQ ID NO: 69419 - protein, 238 aa, Homo sapiens
  Payload ID: 13770
  Gene Symbol: PTPRM
  Gene Name: protein tyrosine phosphatase, receptor type, M
  ENSP ID: ENSP00000462809
  MOD_RES (1)..(1): Any amino acid
XDIKVTLIETELLAEYVIRTFAVEKGGAGGEANCSPSREVSQRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESS

SEQ ID NO: 69420 - protein, 1465 aa, Homo sapiens
  Payload ID: 13770
  Gene Symbol: PTPRM
  Gene Name: protein tyrosine phosphatase, receptor type, M
  Uniprot ID: P28827
  ENSP ID: ENSP00000463325
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILVPINDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 69421 - protein, 173 aa, Homo sapiens
  Payload ID: 13770
  Gene Symbol: PTPRM
  Gene Name: protein tyrosine phosphatase, receptor type, M
  ENSP ID: ENSP00000463558
MGTLSLHPGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKL

SEQ ID NO: 69422 - protein, 207 aa, Homo sapiens
  Payload ID: 13770
  Gene Symbol: PTPRM
  Gene Name: protein tyrosine phosphatase, receptor type, M
  ENSP ID: ENSP00000464128
HFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILELL

SEQ ID NO: 69423 - protein, 979 aa, Homo sapiens
  Payload ID: 13771
  Gene Symbol: PTPRN
  Gene Name: protein tyrosine phosphatase, receptor type, N
  Uniprot ID: Q16849
  ENSP ID: ENSP00000295718
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ
